(12) United States Patent
Huang

(10) Patent No.: US 11,858,975 B2
(45) Date of Patent: Jan. 2, 2024

(54) MULTI-DOMAIN ACTIVE PROTEIN FOR TREATING METABOLIC DISEASES

(71) Applicant: ZHEJIANG DOER BIOLOGICS CORPORATION, Zhejiang (CN)

(72) Inventor: Yanshan Huang, Zhejiang (CN)

(73) Assignee: ZHEJIANG DOER BIOLOGICS CORPORATION, Zhejiang (CN)

( * ) Notice: Subject to any disclaimer, the term of this patent is extended or adjusted under 35 U.S.C. 154(b) by 548 days.

(21) Appl. No.: 16/762,942

(22) PCT Filed: Nov. 19, 2018

(86) PCT No.: PCT/CN2018/116244
§ 371 (c)(1),
(2) Date: Aug. 9, 2020

(87) PCT Pub. No.: WO2019/101042
PCT Pub. Date: May 31, 2019

(65) Prior Publication Data
US 2021/0070829 A1 Mar. 11, 2021

(30) Foreign Application Priority Data
Nov. 24, 2017 (CN) .......................... 201711195356.5

(51) Int. Cl.
*C07K 14/605* (2006.01)
*A61P 3/00* (2006.01)

(52) U.S. Cl.
CPC .............. *C07K 14/605* (2013.01); *A61P 3/00* (2018.01)

(58) Field of Classification Search
CPC .. C07K 14/605; C07K 2319/30; C07K 14/50; A61P 3/04
See application file for complete search history.

(56) References Cited

U.S. PATENT DOCUMENTS

| 10,232,020 B2 * | 3/2019 | Dimarchi | C07K 14/575 |
| 2004/0053370 A1 * | 3/2004 | Glaesner | A61P 3/10 435/325 |
| 2009/0305986 A1 * | 12/2009 | Belouski | C07K 14/50 530/391.1 |
| 2014/0056893 A1 * | 2/2014 | Coskun | C07K 14/605 435/69.6 |

FOREIGN PATENT DOCUMENTS

| KR | 20120068755 | * | 6/2012 |
| WO | WO 91/11457 | * | 8/1991 |

OTHER PUBLICATIONS

Vishal Gupta, Indian J. Endocrionology and Metab, 2013, 17: 413-421.*

* cited by examiner

*Primary Examiner* — Gyan Chandra

(57) ABSTRACT

The present disclosure belongs to the field of biopharmaceuticals, and in particular, relates to a multi-domain active protein for treating metabolic diseases. The multi-domain active protein has a structural formula as shown in Formula I: $A\text{-}L_a\text{-}F\text{-}L_b\text{-}B$. The multi-domain active protein of the present disclosure has a long half-life and supports a once-a-week administration frequency. The GLP-1R agonist activity of the multi-domain active protein is increased up to over 200 times. The multi-domain active protein has good stability in vitro and in vivo, and shows low immunogenicity potential. As introduction of non-natural amino acids is not required and chemical synthesis and crosslinking steps are not involved, the multi-domain active protein can be prepared recombinantly. Therefore, the preparation process is greatly simplified.

14 Claims, 7 Drawing Sheets
Specification includes a Sequence Listing.

*, Compared to C002L$_{13}$F$_8$L$_{10}$W, p<0.05

*, Compared to Liraglutide, p<0.05

*, Compared to Liraglutide, p<0.05

\*\*\*, Compared to corresponding Liraglutide value, p<0.001
\*\*, Compared to corresponding Liraglutide value, p<0.01
\*, Compared to corresponding Liraglutide value, p<0.05

MULTI-DOMAIN ACTIVE PROTEIN FOR TREATING METABOLIC DISEASES

CROSS REFERENCES TO RELATED APPLICATIONS

This is a Sect. 371 National Stage application of a PCT International Application No. PCT/CN2018/116244, filed on Nov. 19, 2018, which claims the benefits of priority to Chinese Patent Application No. 2017111953565, entitled "Multi-Domain Active Protein for Treating Metabolic Diseases", filed with CNIPA on Nov. 24, 2017, the contents of which are incorporated herein by reference in its entirety.

TECHNICAL FIELD

The present disclosure belongs to the field of biopharmaceuticals, and in particular, relates to a multi-domain active protein for treating metabolic diseases.

BACKGROUND

Diabetes can be divided into Type 1 diabetes and Type 2 diabetes according to pathological characteristics. Type 1 diabetes is mainly manifested by insufficient insulin secretion and requires daily insulin injections; type 2 diabetes is caused by inability of the body to effectively use insulin. Most of the diabetes patients are Type 2 diabetes patients. It is estimated that approximately 80-90% of patients with Type 2 diabetes are significantly obese (Center for disease control and prevention (CDC) National Diabetes Fact Sheet, 2014).

Conventional drugs for treating Type 2 diabetes, such as sulfonylureas and thiazolidinediones, are effective in lowering blood glucose, but their main drawback is that they may lead to weight gain (Kahn SE, Haffner SM, Heise MA, Herman WH, Holman RR, Jones NP, et al. Glycemic durability of rosiglitazone, metformin, or glyburide monotherapy. N Engl J Med 2006; 355(23):2427-43.). The protein drugs for Type 2 diabetes are mainly GLP-1R (GLP-1 receptor) agonists, such as Dulaglutide (trade name: TRULICITY®), Albiglutide (trade name: TANZEUM®), Liraglutide (trade names: SAXENDA® and VICTOZA®, used to treat obesity and diabetes, respectively), Exenatide (trade name: BYETTA®), lixisenatide (trade name: LYXUMIA®) and Semaglutide. GLP-1R agonists have a significant hypoglycemic effect. Unlike insulin, the hypoglycemic effect of GLP-1R agonists is strictly blood-glucose-dependent, which is less likely to cause hypoglycemia, and also has a weight loss effect. For example, the weight loss caused by Dulaglutide is about 2.9 kg, while 8 kg by Liraglutide (3 mg, once daily), which is approved for obesity. These drugs reduce appetite and mostly achieve less than 10% body weight loss. Bariatric surgery, which significantly ameliorates obesity and diabetes, is not widely used because surgery risk and long-term sequelae prevent most patients from surgical intervention. (Obesity and Diabetes, New Surgical and Nonsurgical Approaches, Springer Press, 2015)

It is reported that incretins increased dramatically in patients after bariatric surgery (Obesity and Diabetes, New Surgical and Nonsurgical Approaches, Springer Press, 2015). Therefore, the new generation medications for diabetes mainly focused on the development of dual-agonists or poly-agonists targeting incretin receptors, such as GLP-1R/GIPR and GLP-1R/GCGR dual-agonists, and GLP-1R/GIPR/GCGR tri-agonists.

Glucagon receptors and GLP-1 (Glucagon-like peptide-1) receptors are structurally related, but the two hormones show diametrically opposite effects in glucose control. GLP-1 receptor agonists on market are mainly approved for blood glucose control in patients with type 2 diabetes, while the glucagon is only indicated for acute hypoglycemia. In recent years, emerging research suggests that glucagon, despite of its risk of raising blood glucose, may contribute to weight loss. More importantly, GLP-1 and Glucagon seem to have a positive additive or synergistic physiological effect. For example, Glucagon receptor (GCGR) and GLP-1 receptor (GLP-1R) dual-agonists are more effective than GLP-1R mono-agonists in weight loss. Although GCGR stimulation may lead to an increase in blood glucose levels, this risk may be appropriately offset by GLP-1R stimulation.

At present, GLP-1R and GCGR dual-agonists are generally based on Oxyntomodulin or Glucagon (Oxyntomodulin analogues or Glucagon analogues), and have been modified to improve their short half-lives and resistance to enzymatic hydrolysis. Most of these analogues were developed with an unnatural amino acid Aib substitution at position two to promote resistance to DPP-IV cleavage. Like GLP-1, native Glucagon and Oxyntomodulin are susceptible to DPP-IV cleavage in serum and result in inactivation (Victor A. Gault et al., A novel GLP-1/glucagon hybrid peptide with triple-acting agonist activity at GIP, GLP-1 and glucagon receptors and therapeutic potential in high-fat fed mice, J Biol Chem., 288(49):35581-91. 2013; Bhat VK et al., A DPP-IV-resistant triple-acting agonist of GIP, GLP-1 and glucagon receptors with potent glucose-lowering and insulinotropic actions in high-fat-fed mice, Diabetologia, 56(6):1417-24. 2013; John A. Pospisilik et al.; Metabolism of glucagon by dipeptidyl peptidase IV (CD26), Regulatory Peptides 96:133-141, 2001; Hinke S A et al., Dipeptidyl peptidase IV (DPIV/CD26) degradation of glucagon. Characterization of glucagon degradation products and DPIV-resistant analogs, J Biol Chem 275: 3827-3834, 2000; Alessia Santoprete et al., DPP-IV-resistant, long-acting oxyntomodulin derivatives, J. Pept. Sci., 17: 270-280, 2011).

FGF21 belongs to a family of polypeptides that are widely expressed in developing and adult tissues and play an important role in various physiological functions. FGF21 is mainly expressed in pancreatic $_R$ cells, liver, WAT and skeletal muscle. Recently, FGF21 is also found to have low expression in thymus, vascular endothelium, kidney and testicular tissues, and has obvious tissue specificity. FGF21, FGF15/19 and FGF23 all belong to the FGF family of "endocrine" hormones.

As an important metabolic regulator, FGF21 has been shown to improve a variety of metabolic abnormalities in the preclinical models of Type 2 diabetes mellitus (T2DM). As a therapeutic for diabetes, FGF21 has potential effects in increasing insulin sensitivity, improving blood glucose control, weight loss, lowering low-density lipoprotein cholesterol (LDL-C) and triglycerides, and increasing high-density lipoprotein cholesterol (HDL-C) levels. In diabetic mice and monkeys, human FGF21 decrease fasting blood glucose, fasting blood triglyceride, insulin and glucagon. In addition, in rodent models of diet-induced obesity, the administration of FGF21 results in a dose-dependent overall weight loss. Therefore, FGF21 shows a therapeutic potential for treating diseases such as diabetes, obesity, dyslipidemia and metabolic syndrome.

However, the half-life of FGF21 was 30 minutes in mice and 2 hours in monkeys, respectively. Therefore, to maintain biological activities in vivo, daily injection or continuous infusion of corresponding FGF21 protein is required. In human studies, circulating FGF21 levels are often elevated in patients with obesity, dyslipidemia, T2DM, and other diseases related to insulin resistance. Studies have shown that increased FGF21 concentration is associated with an increased risk of CVD, and can also lead to osteoporosis and affect reproduction (promoting metabolism and leading to energy deficiency) (Wei W, Dutchak P A, Wang X, Ding X, Wang X, Bookout A L, et al. Fibroblast growth factor 21 promotes bone loss by potentiating the effects of peroxisome proliferator-activated receptor gamma. Proc Natl Acad Sci USA. 2012;109(8):3143-8; Fibroblast growth factor 21 has no direct role in regulating fertility in female mice, Mol Metab, 5(8):690-8, 2016). The homology of the FGF family sequence and the wide distribution of FGFR1 receptors have also raised concerns about the potential safety issues brought by the high-dose clinical use of FGF21 (Kharitonenkov A & DiMarchi R: Fibroblast growth factor 21 night watch: advances and uncertainties in the field. J Intern Med. 2017 March; 281(3):233-246).

GCGR/GLP-1R dual-agonists and FGF21 analogues are used for the treatment of diabetes and obesity, respectively. In addition, there are reports of fusing GLP-1 variant and FGF21 variant to form a dual-agonist via $F_C$ fragment (YH25723, a Novel Long-Acting GLP-1/FGF21 Dual Agonist Provides More Potent and Sustained Glycemic Control and Greater Weight Loss Compared with Single Agonists in Animal Models, The American Diabetes Association, 2016). As described above, some amino acids in Glucagon/Oxyntomodulin based dual-agonist peptides or tri-agonist peptides were generally substituted with unnatural amino acids to improve stability and activities. These peptides were also further modified by fatty acids or PEG, which is extremely difficult to fuse with FGF21 analogues into a single molecule and recombinantly expressed. The combination of dual- or poly-agonist polypeptides with FGF21 analogues is not yet reported currently.

SUMMARY

The present disclosure provides a multi-domain active protein for treating metabolic and related diseases and preparation and application thereof. The poly-agonist proteins of the present disclosure have a significant effect in weight loss, and can be used in the clinical treatment of diabetes, obesity, non-alcoholic fatty liver disease, hyperlipidemia and other related diseases.

The objects of the present disclosure are achieved by the following technical solutions:

A first aspect of the present disclosure provides a kind of multi-domain active proteins. The multi-domain active proteins include a structure shown in Formula I: A-$L_a$-F-$L_b$-B. A is a GCGR/GLP-1R dual-agonist peptide, F is a long-acting protein unit, B is a native FGF21 or FGF21 analogue, $L_a$ does not exist or is a peptide linker $L_b$ does not exist or is a peptide linker.

The multi-domain active protein combines GLP-1, GCG and FGF21 agonism.

Further, in Formula I, A includes the structure shown in Formula II, and the structure shown in Formula II is as follows:

HSQGTFTSD-$X_{10}$-S-$X_{12}$-$X_{13}$-$X_{14}$-$X_{15}$-$X_{16}$-$X_{17}$-$X_{18}$-$X_{19}$-$X_{20}$-$X_{21}$-

F-$X_{23}$-$X_{24}$-WL-$X_{27}$-$X_{28}$-$X_{29}$-$X_{30}$-$X^z$.

The $X_{10}$ is selected from V, L or Y; the $X_{12}$ is selected from S, E or K; the $X_{13}$ is selected from Y or Q; the $X_{14}$ is selected from L or M; the $X_{15}$ is selected from D or E; the $X_{16}$ is selected from S, E or G; the $X_{17}$ is selected from R, E or Q; the $X_{18}$ is selected from R, E or A; the $X_{19}$ is selected from A or V; the $X_{20}$ is selected from Q, R or K; the $X_{21}$ is selected from D, L or E;

The $X_{23}$ is selected from V or I; the $X_{24}$ is selected from Q, A or E; the $X_{27}$ is selected from M, K or V; the $X_{28}$ is selected from N or K; the $X_{29}$ is selected from G or T; the $X_{30}$ is G or missing; the $X^z$ does not exist or is selected from GPSSGAPPPS (SEQ ID NO. 3), PSSGAPPPS (SEQ ID NO. 4), SSGAPPPS (SEQ ID NO. 5), GPSSGAPPS (SEQ ID NO. 6), PSSGAPPS (SEQ ID NO. 7) or KRNRNN IA (SEQ ID NO. 8).

Further, the amino acid sequence of A is shown in any one of SEQ ID NO. 44-92.

In Formula I, the B is native FGF21 (SEQ ID NO. 136) or FGF21 analogue. The B includes the following structure: HPIPDSSPLLQFGGQVRQX$_{19}$YLYTDDAQQTEX$_{31}$ HLEIX$_{36}$EDGTVGX$_{43}$AX$_{45}$DQSPESLLQLX$_{56}$ ALKPGVIQILGVKT SRFLCQRPDGALYGSLHFDPE ACSFREX$_{98}$LLEDGYNVYQSEAHGLPLHX$_{118}$PGNX$_{122}$ SPHRDPAPRGPX$_{134}$RFLPLPGLPPALPEPPGILAPQPP DVGSSDPLX$_{167}$MVX$_{170}$X$_{171}$SQX$_{174}$RSPSX$_{179}$ X$_{180}$X$_{181}$, and N terminal HPIPDSS may be missing or partially missing; X$_{19}$ is selected from R, Y, V, E or C; X$_{31}$ is selected from A or C; X$_{36}$ is selected from R or K; X$_{43}$ is selected from G or C; X$_{45}$ is selected from A, K, E or V; X$_{56}$ is selected from K, R, V or I; X$_{98}$ is selected from L, R or D; X$_{118}$ is selected from L or C; X$_{122}$ is selected from K or R; X$_{134}$ is selected from A or C; X$_{167}$ is selected from S, A or R; X$_{170}$ is selected from G or E; X$_{171}$ is selected from P or G; X$_{174}$ is selected from G, A or L; X$_{179}$ is selected from Y, A or F; X$_{180}$ is selected from A or E; X$_{181}$ is selected from S, K or is missing.

The FGF21 analogue is a kind of active proteins that have the same or similar biological functions as native FGF21 (SEQ ID NO. 136) and shares a sequence identity above 80% with native FGF21 (SEQ ID NO. 136). Preferably, the FGF21 analogue shares a sequence identity above 85% with native FGF21 (SEQ ID NO. 136); More preferably, the FGF21 analogue shares a sequence identity above 90% with native FGF21 (SEQ ID NO. 136); More preferably, the FGF21 analogue shares a sequence identity above 95% with native FGF21 (SEQ ID NO. 136). Illustratively, the FGF21 analogue may be selected from the FGF21 analogues or mutants described in patents or applications, such as US 20140213512, U.S. Pat. Nos. 8,188,040, 9,493,530, WO 2016114633, US 20150291677, U.S. Pat. Nos. 9,422,353, 8,541,369, 7,622,445, 7,576,190, US 20070142278, U.S. Pat. No. 9,006,400 or US 20130252884.

Preferably, the FGF21 analogue is shown in SEQ ID NO. 137-148.

Further, the F is an $F_C$ portion derived from mammalian immunoglobulin. The immunoglobulin is a polypeptide molecule containing a disulfide bond, and generally includes two light chains and two heavy chains. The $F_C$ portion of the immunoglobulin used herein has the usual meaning of terms in the field of immunology. Specifically, the term $F_C$ portion refers to an antibody fragment obtained by removing two antigen-binding regions (Fab fragments) from an antibody. The $F_C$ portion may include a hinge region and extend through the CH2 and CH3 domains to reach the C-terminal of the antibody. The $F_C$ portion may further include one or more glycosylation sites. There are five kinds of human immunoglobulins with different functions and pharmacokinetic characteristics in humans: IgG, IgA, IgM, IgD and IgE.

IgG is the most abundant immunoglobulin in serum. IgG also has the longest serum half-life in all immunoglobulins (about 23 days).

Further, F may be selected from a complete $F_C$ portion of an immunoglobulin, a fragment of an $F_C$ portion of an immunoglobulin, or a mutant of an $F_C$ portion of an immunoglobulin.

The $F_C$ portion of the immunoglobulin used in the present disclosure is an $F_C$ region of mammal IgG1, IgG2 or IgG4, or a mutant thereof. Preferably, the $F_C$ portion of the immunoglobulin may be an $F_C$ region of human IgG1, IgG2 or IgG4, or a mutant thereof. More preferably, the $F_C$ portion of the immunoglobulin may be an $F_C$ region of human IgG1 or IgG4, or a mutant thereof. In a preferred embodiment, N297 of the $F_C$ domain is substituted with glycine or alanine, according to EU index in kabat numbering (kabat, E. A. et al., Sequences of proteins of immunological interest, fifth edition, public health service, National Institutes of Health, Bethesda, Md. (1991)).

In a preferred embodiment, the $F_C$ domain is from human IgG4 and is shown in SEQ ID NO.16. In a preferred embodiment, the $F_C$ domain is from human IgG1 and is shown in SEQ ID NO.12. The K at the end of the $F_C$ fragment may be removed to improve product uniformity.

In some embodiments, the amino acid sequence of F is shown in any one of SEQ ID NO. 9-18.

In the above-mentioned multi-domain active proteins of the present disclosure, the GCGR/GLP-1R dual-agonist peptides A is fused with a native FGF21 or FGF21 analog B through a long-acting protein unit F to form a recombinant fusion protein of GLP-1, GCG and FGF21 agonism. A and F may be connected directly or by a peptide linker, $L_a$. F and B may be connected directly or by a peptide linker, $L_b$.

$L_a$ and $L_b$ are flexible polypeptides with appropriate length consisting of glycine (G), serine (S) and/or alanine (A), so that adjacent protein domains can move freely relative to each other. A longer peptide linker may be used if two adjacent domains spatially interfering with each other.

Preferred peptide linkers of the present disclosure include units rich in G, S and/or A, for example, (GS)n, (GGS)n, (GGSG)n, (GGGS)nA, (GGGGS)nA, (GGGGA) nA, and n is an integer of 1-10. In a preferred embodiment, the length of the peptide linkers is 5-26. The exemplary peptide linkers are independently selected from SEQ ID NO. 19-41.

Further, the amino acid sequences of the peptide linkers are shown in any one of SEQ ID NO. 19-41.

Further, the amino acid sequences of the multi-domain proteins are shown in any one of SEQ ID NO. 150-208.

The multi-domain proteins provided by the present disclosure are $F_C$ fusion proteins, which retain the conventional characteristics of $F_C$, such as long half-life in vivo by FcRn binding, as well as capacity of binding to Protein A or G with high affinity and high specificity during separation and purification, so as to achieve high-efficiency purification. These multi-domain active proteins show improved resistance to internal and especially N-terminal cleavage by proteases in serum. N-terminal integrity is critical to biological activities of incretin peptides like Glucagon or GLP-1. Native Glucagon and GLP-1 have short half-lives due to their low molecular weights and N-terminal cleavage by DPP-IV and internal degradation by proteases in vivo. In an embodiment of the present disclosure, the native Glucagon is rapidly degraded and inactivated by DPP-IV even after being fused with $F_C$. However, the corresponding Glucagon analogues can obviously resist DPP-IV attacks.

A second aspect of the present disclosure provides an isolated polynucleotide, which encodes the aforementioned multi-domain active protein.

A third aspect of the present disclosure provides a recombinant expression vector, which includes the aforementioned isolated polynucleotide.

A fourth aspect of the present disclosure provides a host cell, which includes the aforementioned recombinant expression vector, or incorporates the aforementioned exogenous isolated polynucleotide in the genome.

A fifth aspect of the present disclosure provides a method for preparing the aforementioned multi-domain active protein, including: culturing the aforementioned host cell under suitable conditions to express the multi-domain active protein, and then isolating and purifying to obtain the multi-domain active protein.

A sixth aspect of the present disclosure provides the use of the aforementioned multi-domain active protein in the preparation of a drug for treating metabolic diseases related to diabetes.

The multi-domain active protein provided by the present disclosure may be used to treat metabolic syndrome. The metabolic syndrome is generally characteristic of the following three risk factors: (1) abdominal obesity (excessive fatty tissue in or around the abdomen); (2) atherogenic dyslipidemia or dyslipidemia, including high triglycerides, low HDL cholesterol and high LDL cholesterol, which enhance the accumulation of plaque in the arterial wall; (3) elevated blood pressure; (4) insulin resistance or glucose intolerance; (5) thromboid state, such as high fibrin or plasminogen activator inhibitor-1 in blood; and (6) pro-inflammatory state, such as elevated C-reactive protein in blood. Other risk factors may include aging, hormone imbalance and genetic factors.

In addition, the multi-domain active protein provided by the present disclosure may be used to treat obesity. In some aspects, the multi-domain active protein of the present disclosure treats obesity by reducing appetite, decreasing food intake, lowering body fat level in patients, increasing energy consumption and other mechanisms.

A seventh aspect of the present disclosure provides a method for treating metabolism-related diseases, including administrating the aforementioned multi-domain active protein to a subject.

The present disclosure further provides a method for promoting weight loss or preventing weight gain, including administrating the aforementioned multi-domain active protein to a subject.

An eighth aspect of the present disclosure provides a pharmaceutical composition, including the aforementioned multi-domain active protein or culture of the aforementioned host cell, and a pharmaceutically acceptable carrier.

A ninth aspect of the present disclosure provides the use of the aforementioned multi-domain active protein in the preparation of a fusion protein.

A tenth aspect of the present disclosure provides a fusion protein, the fusion protein includes the aforementioned multi-domain active protein.

An eleventh aspect of the present disclosure provides another pharmaceutical composition for treating metabolic and related diseases, including a GCGR/GLP-1R dual-agonist active protein and a FGF21 analogue.

The structure of the GCGR/GLP-1R dual-agonist active protein includes: A-La-F, and the structure of A includes the structure shown in Formula II:

HSQGTFTSD-$X_{10}$-S-$X_{12}$-$X_{13}$-$X_{14}$-$X_{15}$-$X_{16}$-$X_{17}$-$X_{18}$-$X_{19}$-$X_{20}$-$X_{21}$-

F-$X_{23}$-$X_{24}$-WL-$X_{27}$-$X_{28}$-$X_{29}$-$X_{30}$-$X^z$.

The $X_{10}$ is selected from V, L or Y; the $X_{12}$ is selected from S, E or K; the $X_{13}$ is selected from Y or Q; the $X_{14}$ is selected from L or M; the $X_{15}$ is selected from D or E; the $X_{16}$ is selected from S, E or G; the $X_{17}$ is selected from R, E or Q; the $X_{18}$ is selected from R, E or A; the $X_{19}$ is selected from A or V; the $X_{20}$ is selected from Q, R or K; the $X_{21}$ is selected from D, L or E.

The $X_{23}$ is selected from V or I; the $X_{24}$ is selected from Q, A or E; the $X_{27}$ is selected from M, K or V; the $X_{28}$ is selected from N or K; the $X_{29}$ is selected from G or T; the $X_{30}$ is G or missing; the $X^z$ does not exist or is selected from GPSSGAPPPS (SEQ ID NO. 3), PSSGAPPPS (SEQ ID NO. 4), SSGAPPPS (SEQ ID NO. 5), GPSSGAPPS (SEQ ID NO. 6), PSSGAPPS (SEQ ID NO. 7) or KRNRNNIA (SEQ ID NO. 8).

F is a long-acting protein unit, which may be selected from a complete $F_C$ portion of an immunoglobulin, a fragment of an $F_C$ portion of an immunoglobulin, or a mutant of an $F_C$ portion of an immunoglobulin. Further, the amino acid sequence of F is shown in SEQ ID NO. 9-18.

$L_a$ does not exist nor is a peptide linker. $L_a$ is a flexible polypeptide of an appropriate length consisting of glycine (G), serine (S) and/or alanine (A), so that adjacent protein domains can move freely relative to each other. A longer peptide linker may be used if two adjacent domains spatially interfering with each other.

The exemplary peptide linkers are (GS)n, (GGS)n, (GGSG)n, (GGGS)nA (GGGGS)nA and (GGGGA)nA, and n is an integer of 1-10. The exemplary peptide linkers are independently selected from SEQ ID NO. 19-41.

Further, the amino acid sequence of the GCGR/GLP-1R dual-agonist active protein is shown in any one of SEQ ID NO.96, SEQ ID NO.98, SEQ ID NO.100, SEQ ID NO.102, SEQ ID NO.104, SEQ ID NO. 106, SEQ ID NO. 108, SEQ ID NO. 110, SEQ ID NO. 112 and SEQ ID NO. 114-133.

The structure of the long-acting FGF21 analogue includes: F-$L_b$-B, and the structure of B includes:
HPIPDSSPLLQFGGQVRQX$_{19}$YLYTDDAQQTEX$_{31}$HLEIX$_{36}$EDGTVGX$_{43}$AX$_{45}$DQSPESLLQ LX$_{56}$ALKPGVIQILGVKT SRFLCQRPDGA-LYGSLHFDPEAC SFREX$_{98}$LLEDGYNVYQ SEAH GLPLHX$_{118}$PGNX$_{122}$SPHRDPAPRGPX$_{134}$RFLPLPGLPP-ALPEPPGILAPQPPDVGSSDPLX$_{167}$ MVX$_{170}$X$_{171}$SQX$_{174}$RSPSX$_{179}$X$_{180}$X$_{181}$, and N terminal HPIPDSS may be missing or partially missing; $X_{19}$ is selected from R, Y, V, E or C; $X_{31}$ is selected from A or C; $X_{36}$ is selected from R or K; $X_{43}$ is selected from G or C; $X_{45}$ is selected from A, K, E or V; $X_{56}$ is selected from K, R, V or I; $X_{98}$ is selected from L, R or D; $X_{118}$ is selected from L or C; $X_{122}$ is selected from K or R; $X_{134}$ is selected from A or C; $X_{167}$ is selected from S, A or R; $X_{170}$ is selected from G or E; $X_{171}$ is selected from P or G; $X_{174}$ is selected from G, A or L; $X_{179}$ is selected from Y, A or F; $X_{180}$ is selected from A or E; $X_{181}$ is selected from S, K or is missing.

The FGF21 analogue is an active protein that has the same or similar biological function as native FGF21 (SEQ ID NO. 136) and shares sequence identity above 80% with native FGF21 (SEQ ID NO. 136). Preferably, the FGF21 analogue shares sequence identity above 85% with native FGF21 (SEQ ID NO. 136); More preferably, the FGF21 analogue shares sequence identity above 90% with native FGF21 (SEQ ID NO. 136); More preferably, the FGF21 analogue shares sequence identity above 95% with native FGF21 (SEQ ID NO. 136). Illustratively, the FGF21 analogue may be selected from the FGF21 analogue or mutant described in the patents or applications, such as US 20140213512, U.S. Pat. Nos. 8,188,040, 9,493,530, WO 2016114633, US 20150291677, U.S. Pat. Nos. 9,422,353, 8,541,369, 7,622, 445, 7,576,190, US 20070142278, U.S. Pat. No. 9,006,400 or US 20130252884. The FGF21 analogue is shown in SEQ ID NO. 137-148.

F may be selected from a complete $F_C$ portion of an immunoglobulin, a fragment of an $F_C$ portion of an immunoglobulin, or a mutant of an $F_C$ portion of an immunoglobulin. The amino acid sequence of F may be shown in any one of SEQ ID NO. 9-18. $L_b$ does not exist or is a peptide linker. $L_b$ is a peptide linker which includes a unit rich in G, S and/or A, for example, (GS)n, (GGS)n, (GGSG)n, (GGGS)nA, (GGGGS)nA, (GGGGA)nA, and n is an integer of 1-10. In a preferred embodiment, the amino acid length of the peptide linker is 5-26. The exemplary peptide linkers are independently selected from SEQ ID NO. 19-41.

Further, the amino acid sequence of the long-acting FGF21 analogue is shown in any one of SEQ ID NO. 210-221.

A twelfth aspect of the present disclosure provides the use of the aforementioned composition in the preparation of a drug for treating metabolism-related diseases.

A thirteenth aspect of the present disclosure provides another method for treating metabolism-related diseases, including administrating the aforementioned composition containing the GCGR/GLP-1R dual-agonist active protein and the long-acting FGF21 analogue to a subject.

The present disclosure further provides a method for promoting weight loss or preventing weight gain, including administrating the aforementioned composition containing the GCGR/GLP-1R dual-agonist active protein and the long-acting FGF21 analogue to a subject.

As is known to all, incretin-like hormonal proteins like GLP-1 analogues and Exendin-4, may cause side effects such as nausea and vomiting, which are dose-related. Therefore, as long as the ideal blood glucose level can be maintained, reducing the dosage as much as possible will theoretically alleviate the patient's discomfort and side effects. FGF21 is considered to be associated with osteoporosis and reproductive (Fibroblast growth factor-21 concentration in serum and synovial fluid is associated with radiographic bone loss of knee osteoarthritis. Scand J Clin Lab Invest. 2015 April; 75 (2):121-5; Fibroblast growth factor 21 has no direct role in regulating fertility in female mice. Mol Metab. 5(8):690-8, 2016). Theoretically, the risk of side effects of drugs is directly proportional to the dose administered. Safety is most concerned for diabetes drugs. The inventor found that GCG/GLP-1/FGF21 tri-agonist active protein and the above-mentioned composition is highly effective in controlling blood glucose level and weight gain at a low dose, and have minimal effect on the gastrointestinal tract, which may greatly reduces the potential dose of FGF21, thus significantly reducing the risk of potential side effects.

Compared with traditional technologies, the present disclosure has the following beneficial effects:

(1) the multi-domain active protein of the present disclosure has a long half-life and supports a dosing frequency of once-a-week;

(2) the GLP-1R agonist activity of the multi-domain active protein of the present disclosure is increased up to over 200 times;

(3) the multi-domain active protein of the present disclosure has good stability in vitro and in vivo, and has low risk of immunogenicity;

(4) as the introduction of a non-natural amino acid is not required and chemical synthesis and crosslinking steps are not involved, the multi-domain active protein can be simplified by recombinantly prepared.

DETAILED DESCRIPTION OF THE PREFERRED EMBODIMENTS

Figure 1:
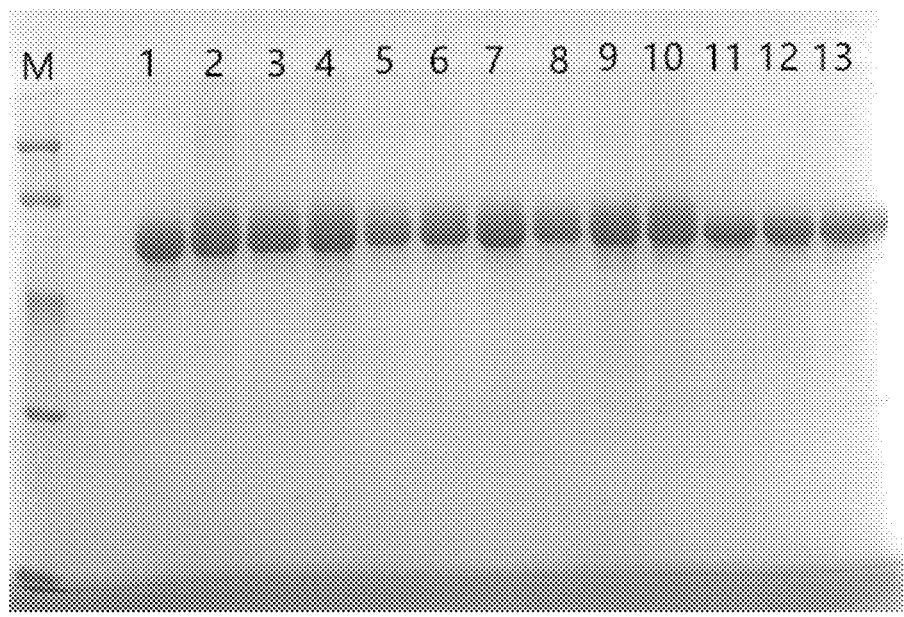
FIG. 1 is a reduced SDS-PAGE electrophoretogram (10% SDS-PAGE) of some purified tri-agonist active proteins; lanes 1-13 represent $C002L_{13}F_4L_{10}W$, $C240\ L_{12}F_8L_{12}M_1$, $C495L_{13}F_8L_{10}M_1$, $C266\ L_{13}F_7L_{13}M_4$, $C462\ L_9F_2L_9M_{10}$, $C611\ L_{11}F_4L_{11}M_{11}$, $C563\ L_{14}F_8L_9M_3$, $C382L_{13}F_8L_{10}M_2$, $C623\ L_9F_3L_{10}M_1$, $C731\ L_5F_2L_9M_9$, $C353\ L_{13}F_3L_{10}M_4$, $C227L_{12}F_5L_{14}M_4$, $C137L_{10}F_8L_9M_5$, respectively; M is a protein standard: 97.2KD, 66.4KD, 44.3KD, 29KD, 20.1KD and 14.3KD.

Explanation of Terms:

The term "diabetes" includes Type 1 diabetes, Type 2 diabetes, gestational diabetes, and other symptoms that cause hyperglycemia. This term is used for metabolic disorders, in which the pancreas cannot produce enough insulin, or the body cells fail to respond to insulin properly, which leads to a decrease in glucose absorption efficiency of tissue cells and causes glucose to accumulate in the blood.

Type 1 diabetes, also known as insulin-dependent diabetes and juvenile-onset diabetes, is caused by the β cells destruction and usually results in absolute insulin deficiency.

Type 2 diabetes, also known as non-insulin-dependent diabetes and adult-onset diabetes, is generally associated with insulin resistance.

The term "obesity" refers to excess fatty tissue, caused by excess calories stored in fat when energy intake exceeds energy consumption. In this article, individuals with a body mass index (BMI=body weight (kg) divided by the square of height (m)) exceeding 25 are considered obese.

Incretin is a gastrointestinal hormone that regulates blood glucose by enhancing glucose-stimulated insulin secretion (also known as glucose-dependent insulin secretion, GSIS) (Drucker.D J, Nauck, M A, Lancet 368: 1696-705, 2006). Incretin can also slow down the rate of nutrient absorption by delaying gastric emptying, and directly reduce food absorption. At the same time, Incretin can also inhibit intestinal a cells from secreting Glucagon. Hitherto, there are two known types of incretin: glucagon-like peptide-1 (GLP-1) and Glucose-dependent insulinotropic polypeptide (GIP).

PreproGlucagon is a precursor polypeptide consisting of 158 amino acids. PreproGlucagon is differentially processed in tissues to form a variety of structurally related proglucagon-derived peptides, including Glucagon, Glucagon-like peptide-1 (GLP-1), Glucagon-like peptide-2 (GLP-2) and Oxyntomodulin (OXM).

GIP is a 42-amino acid peptide obtained by the proteolytic processing of 133-amino acid precursor (pre-pro-GIP). These molecules are involved in various biological functions, including glucose homeostasis, insulin secretion, gastric emptying and intestinal growth, and food intake regulation.

The sequence of Glucagon-like peptide (GLP-1) is shown in SEQ ID NO: 1; GLP-1 is a 30- or 31-amino acid polypeptide intestinal incretin hormone secreted from intestinal L-cells. GLP-1 includes two active forms of GLP-1 (7-36) and GLP-1 (7-37). GLP-1 is released into the circulation after a meal and exerts its biological activity by activating GLP-1 receptors. GLP-1 has various biological effects, including stimulation of glucose-dependent insulin secretion, inhibition of glucagon production, delay of gastric emptying, and appetite suppression (Tharakan G, Tan T, Bloom S. Emerging therapies in the treatment of 'diabesity': beyond GLP-1. Trends Pharmacol Sci 2011; 32 (1): 8-15). Native GLP-1 is readily degraded by dipeptidyl peptidase-4 (DPP-IV), neutral endopeptidase (NEP), plasma kallikrein or plasmin, which limits its therapeutic potential. Since native GLP-1 has a short half-life of about 2 minutes in vivo, chemical modifications and/or formulations design are usually considered to improve therapeutic efficacy of GLP-1 derived medicines for diabetes and obesity (Lorenz M, Evers A, Wagner M. Recent progress and future options in the development of GLP-1 receptor agonists for the treatment of diabesity. Bioorg Med Chem Lett 2013; 23 (14): 4011-8; Tomlinson B, Hu M, Zhang Y, Chan P, Liu ZM. An overview of new GLP-1 receptor agonists for type 2 diabetes. Expert Opin Investig Drugs 2016; 25 (2): 145-58).

Oxyntomodulin is a small peptide of 37 amino acids, the sequence is shown in SEQ ID NO: 2; Oxyntomodulin contains the complete 29 amino acid sequence of Glucagon (SEQ ID NO: 42). Oxyntomodulin is a dual-agonist for GLP-1R and GCGR, and is secreted together with GLP-1 through intestinal L-cells after a meal. Similar to Glucagon, Oxyntomodulin induces significant weight loss in humans and rodents. The weight-loss activity of oxyntomodulin has been compared with equimolar doses of GLP-1R mono-agonists in obese mice. Oxyntomodulin showed an anti-hyperglycemic effect compared with GLP-1R mono-agonists, and significantly induced weight loss and lipid decrease (The Glucagon receptor is involved in mediating the body weight-lowering effects of oxyntomodulin, Kosinski J R, etc., Obesity (Silver Spring), 20): 1566-71, 2012). Overweight and obese subjects receiving subcutaneous administration of oxyntomodulin over a 4-week period resulted in an average weight loss of 1.7 kg.

Oxyntomodulin is also proved to reduce food intake and increase energy expenditure in humans (Subcutaneous oxyntomodulin reduces body weight in overweight and obese subjects: a double-blind, randomized, controlled trial, Wynne K et al., Diabetes, 54: 2390-5, 2005; Oxyntomodulin increases energy expenditure in addition to decreasing energy intake in overweight and obese humans: a randomized controlled trial; Wynne K et al., Int J Obes (Lond), 30: 1729-36, 2006). But likewise, Oxyntomodulin has a short half-life due to low molecular weight and degradation by DPP-IV. Currently, dual GLP-1Rand GCGR agonists are generally derived from Oxyntomodulin. Mutations (Oxyntomodulin analogue) are introduced to improve defect of Oxyntomodulin, including short half-life and incapacity to resisting enzymatic hydrolysis. Most of the mutations substituting the second serine (Ser) to a-aminoisobutyric acid (Aib), a non-natural amino acid contributes to resistance to DPP-IV cleavage. Although Oxyntomodulin analogues have shown initial hypoglycemic and fat-reducing effects, the exact mechanism remains unclear. The Oxyntomodulin receptor has not been found. Currently, only results from GCGR- or GLP-1R-knockout mice or cell bioassaies have provided evidences for Oxyntomodulin's functions through binding to the two receptors.

Glucagon is a 29-amino acid peptide, which corresponds to amino acids at position 53-81 of preproGlucagon, the sequence is shown in SEQ ID NO: 42 (CG Fanelli et al., Nutrition, Metabolism & Cardiovascular Diseases (2006) 16, S28-S34). Glucagon receptor activation has been shown to increase energy consumption and reduce food intake in both rodents and humans (Habegger K M et al., The metabolic actions of Glucagon revisited, Nat. Rev. Endocrinol. 2010, 6,689-697), and the effects are stable and persistent in rodents. Glucagon has many physiological effects, such as increasing blood glucose levels in hypoglycemic conditions by stimulating glycogen breakdown and gluconeogenesis, regulating the production of liver ketone, regulating the bile acid metabolism and vagus nerve-through satiety effects. Glucagon is indicated for acute hypoglycemia clinically. Glucagon receptor activation reduces food intake, and promotes fat breakdown and weight loss in animals and humans.

The term "receptor agonist" may be defined as a polypeptide, protein, or other small molecules that bind to a receptor and triggers a reasonable response as its native ligand.

"GLP-1 receptor (GLP-1R) agonist" may be defined as a polypeptide, protein, or other small molecules that bind to GLP-1R and trigger the same or similar response as native GLP-1. GLP-1R agonists activate GLP-1R completely or partially, and then cause a series of downstream signaling pathway reactions inside the cell to produce corresponding biological activity, such as β cells secreting insulin. Typical GLP-1R agonists include native GLP-1 and mutants and analogues thereof, such as Exenatide, Liraglutide and the like.

GLP-1 analogues: as used herein, "GLP-1 analogues" or "GLP-1 mutants" all mean GLP-1R agonists and may be used interchangeably.

Glucagon receptor (GCGR) agonist: Glucagon receptor agonist, which may be defined as a polypeptide, protein or other small peptides that bind to GCGR and can initiate the same or similar characteristic response as native Glucagon. GCGR agonists activate GCGR completely or partially, and then cause a series of downstream signaling pathway reactions inside the cell to produce corresponding biological activity, such as glycogenolysis of hepatocytes, gluconeogenesis, fatty acid oxidation and ketogenesis.

Glucagon analogues: as used herein, "Glucagon analogues", "GCG analogues", "Glucagon mutants" and "GCG mutants" all mean Glucagon receptor agonists and may be used interchangeably.

GCGR/GLP-1R dual-agonist active peptide: the GCGR/GLP-1R dual-agonist active peptide of the present disclosure includes proteins or polypeptides that can simultaneously stimulate GLP-1R and GCGR. Such as the Oxyntomodulin-based dual-agonist as reported by Alessandro Pocai et al. (Glucagon-Like Peptide 1/Glucagon Receptor Dual Agonism Reverses Obesity in Mice, Diabetes; 58 (10): 2258-2266, 2009) or the dual-agonist based on Glucagon as reported by Richard D. DiMarchi et al. (US9018164 B2). Herein, "dual-agonist" or "bispecific active protein" or "dual-effective protein" are synonymous.

FGF21 (Fibroblast growth factor 21), FGF15/19 and FGF23 belong to the "endocrine" hormone of the FGF family. FGF21 is an important hormone that regulates glucose and lipid metabolism. Unlike insulin, FGF21 promotes glucose uptake in adipocytes by up-regulating the expression of GLUT1. The binding of FGF21 to the receptor requires the assistance of the transmembrane protein β-Klotho, which stimulates signal transduction by binding to the FGFR/β-Klotho receptor complex, to trigger the biological effects of liver, adipose tissue, and pancreas. β-Klotho is exclusively expressed in pancreas, liver, and adipose, which also explains the specificity of FGF21 on these tissues (Kurosu H et al., Tissue-specific expression of beta Klotho and fibroblast growth factor (FGF) receptor isoforms determines the metabolic activity of FGF19 and FGF21. J Biol Chem 282: 26687-26695, 2007; Kharitonenkov A et al., (2008b) FGF-21/FGF-21 receptor interaction and activation is determined by beta Klotho. J Cell Physiol 215: 1-7). In the presence of the co-receptor β-Klotho, FGF21 can bind to and activate three FGFR subtypes (1c, 2c and 3c). Other FGFR subtypes, such as FGFR1b, FGFR2b and FGFR3b are not considered as FGF21 receptors due to inability to form complexes with β-Klotho Evidence suggests that among FGFR receptors binding to FGF21, FGFR1 plays a dominant role in the regulation of FGF21 activity. The N-terminal and C-terminal of FGF21 are very important for functional activity, where the N-terminal binds to FGFR and the C-terminal binds to β-Klotho (Micanovic R, et al (2009) Different roles of N- and C-termini in the functional activity of FGF21. J Cell Physiol 219: 227-234). The mouse FGF21 protein is composed of 210 amino acids with a N-terminal 30-amino acid signal peptide, while human FGF21 protein is 209-amino acid in length with a N-terminal signal peptide of 28 amino acids. Human FGF21 shares about 75% sequence identity with mouse FGF21. FGF21 is mainly expressed in pancreatic β cells, liver, WAT, skeletal muscle, and shows obvious tissue specificity. Human FGF21 is readily degraded by prolinase (FAP, a serine protease) in vivo, with a half-life of 30 minutes in mice and 2 hours in monkeys.

Multi-domain: a domain is a region in a biological macromolecule that has a specific structure and independent function, especially in a protein. In a globular protein, a domain has its own specific tertiary structure and functions independently of the rest of the protein molecule. Different domains in the same protein often be connected by short linker sequences without secondary structure. Individual domains in a protein make up a multi-domain. In the present disclosure, multi-domain refers to a fusion protein containing GCG analogues, FGF21 or FGF21 analogues and $F_C$, which have GCGR agonist activity, GLP-1R agonist activity and FGF21 activity.

Dimer: A dimer in the present disclosure is formed by the native non-covalent and covalent action of the constant region ($F_C$) of the immunoglobulin. If not otherwise specified, the dimers formed by $F_C$ are all homodimers, as described in the dimers provided by the present disclosure. The active protein described in Formula I will form a dimer due to the presence of $F_C$.

Tri-agonist active protein: herein, "tri-agonist active protein", "three-activity agonist active protein", and "trispecific dimer active protein" are all synonymous and can be used interchangeably.

$EC_{50}$ (concentration for 50% of maximal effect) refers to the concentration required for a drug or substance to stimulate 50% of its corresponding biological response. The lower the $EC_{50}$ value, the stronger the stimulation or agonism of the drug or substance. More intuitively, for example, the stronger the intracellular signal caused, the better the ability to induce the production of a hormone.

Cell-Based Bioactivity Assay

A luciferase reporter assay was used to determine the in vitro GLP-1R and GCGR agonist activities in a cell-based bioactivity assay in present disclosure. The luciferase reporter assay is based on the principle that GLP-1R and GCGR can activate the downstream cAMP pathway after activation. Bioactivity determination of FGF21 and its analogues was obtained by detecting fluorescence signal change in a CHO cell co-transfected with β-klotho and FGF21R genes.

According to the report of Joseph R. Chabenne et al. and Richard D. DiMarchi et al., adding a C-terminal small peptide Cex (SEQ ID NO: 3 GPSSGAPPPS) from Exendin-4 to the C-terminal of Glucagon increased the GLP-1R agonist activity by about 2 times (Optimization of the Native Glucagon Sequence for Medicinal Purposes, J Diabetes Sci Technol, 4 (6): 1322-1331, 2010 and patent US9018164 B2), but the ratio of GCGR agonist activity to GLP-1R agonist activity was only about 35: 1. In addition, Evers A et al. reported that (Evers A et al., Design of Novel Exendin-Based Dual Glucagon-like Peptide 1 (GLP-1)/Glucagon Receptor Agonists, J Med Chem.; 60 (10): 4293-4303. 2017) after adding the Cex sequence to the C-terminal of GCG analogue, GLP-1R agonist activity decreased by about 3 times, and GCG activity decreased by about 14 times (Table 2, peptides 7 and 8 in the article).

In an embodiment of the present disclosure, when a GCG analogue containing GPSSGAPPPS (SEQ ID NO. 3) or a similar sequence was further fused to a an $F_c$ domain, GLP-1R agonist activity increased by a staggering 200 times ($EC_{50}$ of about 1.1 nM). While for the GCG analogues disclosed in US9018164 B2 and other patents and literatures by Joseph R. Chabenne et al., the ratio of GLP-1R agonist activity changed only about 2 times before and after adding GPSSGAPPPS (SEQ ID NO. 3) or a similar sequence (For example, GLP-1R agonist activity of native Glucagon relative to native GLP-1 in paper was 0.7%, but increased to 1.6% after adding the GPSSGAPPPS (SEQ ID NO. 3) sequence). That is, addition of GPSSGAPPPS (SEQ ID NO. 3) sequence to the Glucagon polypeptide C-terminally did not necessarily increase GLP-1R agonist activity significantly.

Stability of the Multi-Domain Active Protein

There are several sensitive cleavage sites in native Glucagon, including position 2 recognized by DPP-IV, and SRR at positions 16-18. Although several reporters speculated that $F_C$ improve the chemical stability and serum stability of some active protein, the role of $F_C$ to GLP-1 or Glucagon analogues which N-terminal must be exposed seems to be inconclusive. After fusion of native GLP-1 or Glucagon with $F_C$ fragment, N-terminal degradation was still obviously observed under 37 ° C. in serum. To improve stability, the present disclosure introduces a mutation that is resistant to protease hydrolysis on the basis of native Glucagon. After the fusion of the mutant with $F_C$, the stability is further improved.

At present, almost all GCGR/GLP-1R dual-agonists derived from Oxyntomodulin and Glucagon have introduced mutations that resist to DPP-IV cleavage at position two. For example, the mutation of L-amino acid to D-amino acid (L-Ser mutated to D-Ser), or the introduction of an unnatural amino acid such as Aib (Matthias H. Tschop, etc., Unimolecular Polypharmacy for Treatment of Diabetes and Obesity, 24:51-62, 2016). However, in the embodiments of the present disclosure, the dual-agonist active protein derived from Formula II and retaining native L-Ser in position two exhibits very high serum stability, without any sign of significant degradation by DPP-IV at 24 hours, while the corresponding peptides without $F_C$ fusion were rapidly hydrolyzed by DPP-IV (Table 4). The inventors prepared an active protein $COO1L_{13}F_8$ (SEQ ID NO.93) in which native Glucagon was fused with $F_C$, and an active protein $C002L_{13}F_8$ (SEQ ID NO.94) in which Glucagon-cex was fused with $F_C$ according to the report of Joseph R. Chabenne et al. The two active proteins serve as a control to verify whether $F_C$ fusion did improve stability. However, neither $COO1L_{13}F_8$ (SEQ ID NO.93) nor $C002L_{13}F_8$ (SEQ ID NO.94) showed obvious signs of resistance to DPP-IV cleavage. Although some reports have suggested that binding to serum albumin (such as HSA) may help improve protein stability (such as liraglutide), half-life was still shorter than 12 hours if position two remained unchanged. That is, it is impossible to support a dosing frequency of once-a-week. The pharmacokinetic and pharmacodynamic profiles have shown that the GCG analogues provided by the present disclosure are sufficient to support a dosing frequency of once-a-week rather than once a day as generally reported (for example, albumin-binding liraglutide). The retention of native amino acids further reduces immunogenicity risk, avoids chemical crosslinking and makes the preparation process easier and more convenient.

Intraperitoneal Glucose Tolerance Test (IPGTT)

In an embodiment, an IPGTT experiment was conducted. Mice administered with multi-domain active protein showed extremely stable blood glucose fluctuations after injecting glucose.

Weight Loss and Appetite Control in DIO Mice and Pharmacokinetic Studies

GCGR agonists have been reported to have a potential effect on weight loss. However, the therapeutic use of native Glucagon is limited by its rapid degradation and low molecular weight. At present, most Glucagon analogues are used for acute hypoglycemia symptoms potentially. Clinical reports of long-acting GCG analogues for weight loss in diabetic patients are also emerging. It is well known that obesity is one of the causes of insulin resistance in diabetic patients, and weight loss is an important indicator to evaluate a glucose-lowering drug. In addition, the multi-domain active protein of the present disclosure induces a significant weight loss after administration to DIO mice. The roles of GCGR/GLP-1R dual-agonist, FGF21 and its analogues in blood glucose control and lipid metabolism is widely known. Stanislaus S et al. (Stanislaus S et al., A novel Fc FGF21 with improved resistance to proteolysis, increased affinity towards β-Klotho and enhanced efficacy in mice and cynomolgus monkeys Endocrinology. 2017 May 1; 158 (5): 1314-1327.) has reported that $F_C$-FGF21 analogues at a dose of 3 mg/kg (about 30 nM/kg) resulted in a weight loss of more than 15% after 4 weeks of continuous administration. The tri-agonist active proteins (dose of 30 nM/kg) In Embodiment 9 of the present disclosure triggered a weight loss of approximately 30% with appetite basically unchanged. Likewise, a dose of 10 nM/kg triggered a weight loss about 15%. In addition, the combination (A-$L_a$-F plus F-$L_b$-B) of the dual-agonist active protein and the long-acting FGF21 analogue in Embodiment 10 also played a synergistic effect: the combination administered reduced body weight by 35% or more. However, the dual-agonist active proteins with equivalent dose only reduced body weight by no more than 13%, while the long-acting FGF21 analogues only reduced body weight by less than 10%.

Prospect of Clinical Application

Clinically, the multi-domain active proteins of the present disclosure are potentially suitable for once weekly administration or longer according to its pharmacokinetic profiles. The doses selected depend on dosing frequency and route, age, gender, weight, physiological state of the subjects, treatment regimen and pathological conditions any associated diseases and other known to the skilled in the art. At the same time, according to the subjects' physiological state and pathological conditions, the multi-domain active proteins of the present disclosure may be administered or applied in combination with one or more other therapeutically active compounds or substances. For example, the above-mentioned other therapeutically active compounds available include, but are not limited to, anti-diabetic drugs, anti-hyperlipidemia drugs, anti-obesity drugs, anti-hypertensive drugs, and reagents for the treatment of complications arising from or related to diabetes.

Metabolic syndrome is associated with an increased risk of coronary heart disease and other conditions related to the accumulation of vascular plaque, such as stroke and peripheral vascular disease, which become an atherosclerotic cardiovascular disease (ASCVD). Patients with metabolic syndrome may progress from an early insulin resistance state to fully mature Type 2 diabetes, accompanied by an increased risk of ASCVD. Not to be limited to any particular theory, the relationship between insulin resistance, metabolic syndrome and vascular disease may involve one or more common pathogenesis, including insulin-stimulated vasodilation disorder, decreased availability of insulin resistance-related correlations due to increased oxidative stress, and abnormalities of adipocyte-derived hormones (such as adiponectin) (Lteif, Mather, Can. J. Cardiol. 20 (Suppl B): 66B-76B, 2004).

The active proteins provided by the present disclosure may be used to treat obesity. In some aspects, the active proteins of the present disclosure treats obesity by reducing appetite, decreasing food intake, lowering body fat level, increasing energy consumption and other mechanisms in patients.

In some potential embodiments, the active proteins of the present disclosure can be used for the treatment of non-alcoholic fatty liver disease (NAFLD). NAFLD refers to broad-spectrum liver diseases, ranging from simple fatty liver (steatosis) to non-alcoholic steatosis hepatitis (NASH) to liver cirrhosis (irreversible late stage of scarring of the liver). All stages of NAFLD show fat accumulation in liver cells. Simple fatty liver is an abnormal accumulation of certain types of fat and triglycerides in the liver cells, but without signs of inflammation or scar formation. In NASH, fat accumulation is associated with varying degrees of liver inflammation (hepatitis) and scar formation (fibrosis). Inflammatory cells may destroy liver cells (hepatocyte necrosis). In the terms "Steatosis hepatitis" and "Steatosis necrosis", steatosis refers to fatty infiltration, hepatitis refers to inflammation in the liver, and necrosis refers to destroyed liver cells. NASH may eventually lead to liver scarring (fibrosis) and then result in irreversible advanced scarring (liver cirrhosis). Liver cirrhosis caused by NASH is the final and the most severe stage of disease within the NAFLD spectrum.

Before further describing the specific embodiments of the present disclosure, it is understood that the scope of the present disclosure is not limited to the specific embodiments described below. It is also to be understood that the terminology of the disclosure is used to describe the specific embodiments, and not to limit the scope of the disclosure. The test methods without specific conditions noted in the following embodiments are generally based on conventional conditions or the conditions recommended by the manufacturers.

When the numerical values are given by the embodiments, it is to be understood that the two endpoints of each numerical range and any one between the two may be selected unless otherwise stated. Unless otherwise defined, all technical and scientific terms used in the present disclosure have the same meaning as commonly understood by one skill in the art. In addition to the specific methods, equipments and materials used in the embodiments, any method, equipments and materials in the existing technologies similar or equivalent to the methods, equipments and materials mentioned in the embodiments of the present disclosure may be used to realize the invention according to the grasp of the existing technologies and the record of the invention by those skilled in the art.

Unless otherwise stated, the methods of experiments, assays and sample preparation disclosed in the present invention all employ conventional techniques of molecular biology, biochemistry, chromatin structure and analysis, analytical chemistry, cell culture, recombinant DNA technology in the technical field and related fields. These techniques are well described in the prior literatures. For details, see Sambrook et al., MOLECULAR CLONING: A LABORATORY MANUAL, Second edition, Cold Spring Harbor Laboratory Press, 1989 and Third edition, 2001; Ausubel et al, CURRENT PROTOCOLS IN MOLECULAR BIOLOGY, John Wiley & Sons, New York, 1987 and periodic updates. The series METHODS IN ENZYMOLOGY, Academic Press, San Diego; Wolffe, CHROMATIN STRUCTURE AND FUNCTION, Third Edition, Academic Press, San Diego, 1998; METHODS IN ENZYMOLOGY, Vol. 304, Chromatin (P. M. Wassarman and A. P. Wolffe, eds.), Academic Press, San Diego, 1999; and METHODS IN MOLECULAR BIOLOGY, Vol. 119, Chromatin Protocols (P. B. Becker, ed.) Humana Press, Totowa, 1999, and the like.

Embodiment 1

Screening of GCG Analogues (Screening of Glucagon Analogue)

The amino acid sequence of native GLP-1 is shown in SEQ ID NO. 1, specifically:

```
HAEGTTSDVSSYLEGQAAKEFIAWLVKGRG.
```

The amino acid sequence of native Oxyntomodulin is shown in SEQ ID NO. 2, specifically:

HSQGTFTSDYSKYLDSRRAQDFVQWLMNTKRNRNNIA.

The GCG analogue of the present disclosure is denoted as A. The A is a GCGR/GLP-1R dual-agonist active peptide, selected from any peptide that process GCGR and GLP-1R dual-agonist activity.

The structure of A is shown in Formula II:

HSQGTFTSD-$X_{10}$-S-$X_{12}$-$X_{13}$-$X_{14}$-$X_{15}$-$X_{16}$-$X_{17}$-$X_{18}$-$X_{19}$-$X_{20}$-$X_{21}$-

F-$X_{23}$-$X_{24}$-WL-$X_{27}$-$X_{28}$-$X_{29}$-$X_{30}$-$X^z$.

The $X_{10}$ is selected from V, L or Y; the $X_{12}$ is selected from S, E or K; the $X_{13}$ is selected from Y or Q; the $X_{14}$ is selected from L or M; the $X_{15}$ is selected from D or E; the $X_{16}$ is selected from S, E or G; the $X_{17}$ is selected from R, E or Q; the $X_{18}$ is selected from R, E or A; the $X_{19}$ is selected from A or V; the $X_{20}$ is selected from Q, R or K; the $X_{21}$ is selected from D, L or E.

The $X_{23}$ is selected from V or I; the $X_{24}$ is selected from Q, A or E; the $X_{27}$ is selected from M, K or V; the $X_{28}$ is selected from N or K; the $X_{29}$ is selected from G or T; the $X_{30}$ is G or missing. The $X^z$ does not exist or is selected from any one of SEQ ID NO. 3-8.

The amino acid sequences of the exemplary GCG analogues may be independently selected from SEQ ID NO. 42-92, and the corresponding polypeptide codes are C001, C002, C240, C241, C276, C225, C222, C163, C164, C271, C368, C495, C353, C352, C355, C382, C232, C227, C266, C137, C399, C398, C396, C392, C462, C228, C187, C363, C364, C209, C289, C611, C618, C623, C627, C654, C673, C563, C549, C555, C487, C488, C489, C503, C508, C711, C708, C743, C756, C788 and C731, respectively.

Embodiment 2

Preparation of Dual-Agonist Active Protein A-$L_a$-F

In this embodiment, the dimeric dual-agonist active protein A-$L_a$-F is obtained by fusing the GCG analogue with the peptide linker $L_a$ and F. The A is the same as the A in Embodiment 1.

The F is a long-acting protein unit, which may be selected from a complete $F_C$ portion of an immunoglobulin, a fragment of an $F_C$ portion of an immunoglobulin, or a mutant of an $F_C$ portion of an immunoglobulin. The amino acid sequence of F is shown in SEQ ID NO. 9-18, and the corresponding abbreviations are F1-F10, respectively.

$L_a$ is a flexible polypeptide with an appropriate length consisting of glycine (G), serine (S) and/or alanine (A), so that adjacent protein domains can move freely relative to each other. A longer peptide linker may be used if two adjacent domains spatially interfering with each other. The exemplary peptide linkers are (GS)n, (GGS)n, (GGSG)n, (GGGS)nA (GGGGS)nA and (GGGGA)nA, and n is an integer of 1-10. The exemplary peptide linkers may be independently selected from SEQ ID NO. 19-41, and the corresponding codes of the sequence are L1-L23, respectively.

The amino acid sequences of the dual-agonist active proteins moiety, A-$L_a$-F, may be independently selected from SEQ ID NO. 93-133, and the DNA sequences may be independently selected from SEQ ID NO. 222-262, the corresponding codes of the dual-agonist active proteins of A-$L_a$-F are COO1L13F8, C002L13F8, CG283L13F8, C240L13F8, CG214L13F8, C382L13F8, CG267L13F8, C276L13F8, C308L13F8, C368L13F8, C224L13F8, C225L13F8, CG308L13F8, C495L13F8, C319L13F8, C364L13F8, C214L13F8, C232L13F8, C303L13F8, C392L13F8, CG303L13F8, C462L13F8, C240 L12F8, C368 L10F4, C364 L10F4, C352 L13F4, C225 L10F10, C228L13F4, C187 L9F4, C618 L12F4, C623 L9F3, C228 L13F4, C498 L13F4, C503 L15F2, C508 L7F4, C289 L1F4, C756 L20F4 C209 L13F8 and C627 L12F10, respectively.

The skilled in the art can prepare the A-$L_a$-F using the traditional technologies on the basis of knowing the amino acid sequences of the A-$L_a$-F: due to the presence of $F_C$ sequence, Protein A chromatography with high affinity and high specificity for Fc can be used for protein purification. A feasible preparation method is given here illustratively.

The Preparation Process is as Follows:

(1) DNA sequences design according to protein sequences and amino acid codons. Polynucleotide DNA fragments corresponding to A, $L_a$ and F in the recombinant proteins were prepared respectively. Individual DNA fragment can be synthesized and spliced by conventional solid-phase synthesis technologies.

(2) Primer design for nested PCR amplification: DNA splicing for the corresponding fragments of A, $L_a$, and F to obtain the target genes and PCR splicing (including primer design, PCR introduced mutation and enzyme digestion, etc.) are known technologies for the skilled in the art. It's known to the skilled in the art that the PCR splicing method in this embodiment is not exclusive, target genes may also be obtained through gene synthesis. Target genes were cloned into mammalian cell expression vector pTT5 (Yves Durocher) and transformed into E. coli Top10F'. Identified positive clones were inoculated into 500 ml LB medium and incubated overnight, followed by cell collection by centrifugation, and finally plasm ids were exacted by OMEGA E.Z.N.A.® Endo-Free Plasmid Maxi Kit.

(3) Transfection of Hek293F cells and expression: 1.0 mg plasmid was diluted to 25 ml Freestyle 293 expression medium (Thermofisher). 3.0 mg PEI (linear, 25KD) was diluted to 25 ml Freestyle 293 medium and mixed well with the plasmid solution, followed by incubation at room temperature for 30 minutes. At the same time, Hek293F cells in log phase (viability>95%) was counted, followed by centrifugation at 1100 rpm for 10 minutes. After discarding the supernatant, resuspending the cells pellet in 450 ml Freestyle 293 expression medium. After incubation of the PEI-plasmid mixture, adding the PEI-plasmid mixture into the cell suspension and shake-culturing at 37 ° C., 5% $CO_2$, and 140 RPM. After 7 hours, the Freestyle 293 expression medium was replaced with 1000 ml 293 SFM II medium (Thermofisher) followed by culture for 7 days.

(4) Purification of the recombinant protein: cell culture was centrifuge at 8000 rpm for 10 min to collect the supernatant. The supernatant was then loaded onto a Protein A column (Bestchrom (Shanghai) Biotechnology Co., Ltd.) pre-equilibrated with equilibration buffer (20 mM PB, 0.5M NaCl, pH7), and eluted in 100% elution buffer (0.1M Gly-HCl, pH3.0). Eluted sample was collected in a collection tube prefilled with neutralization buffer (1M Tris-HCl, pH 8.0). The final neutralization buffer was ¹⁄₁₀ of the volume of the eluted samples, and protein concentration was determined by Bradford method.

(5) identification of the physicochemical properties of the recombinant proteins: SDS-PAGE electrophoresis or amino acid sequence verification results of the purified recombinant protein were consistent with expectations.

Embodiment 3

Preparation of Tri-Agonist Active Protein

The tri-agonist active proteins of the present disclosure contains multiple domains and has tri-agonist activity. The structure of the tri-agonist active proteins is shown in Formula I: A-$L_a$-F-$L_b$-B. A is a GCGR/GLP-1R dual-agonist agonist active peptide, F is a long-acting protein unit, B is a native FGF21 or FGF21 analogue, $L_a$ and $L_b$ are peptide linkers.

In Formula I, A is the same as the A in Embodiment 1.

In Formula I, F may be selected from a complete $F_C$ portion of an immunoglobulin, a fragment of an $F_C$ portion of an immunoglobulin, or a mutant of an $F_C$ portion of an immunoglobulin, as shown in SEQ ID NO.9-18.

In formula I, B is native FGF21 (SEQ ID NO. 136) or FGF21 analogue. The structure of B is as follows:

HPIPDSSPLLQFGGQVRQ$X_{19}$YLYTDDAQQTE$X_{31}$HLEI$X_{36}$EDGTVG$X_{43}$A $X_{45}$DQSPESLLQL$X_{56}$ALKPGVIQILGVKTSRFLCQRPDGALYGSLHFDPE

ACSFRE$X_{98}$LLEDGYNVYQSEAHGLPLH$X_{118}$PGN$X_{122}$SPHRDPAPRGP $X_{134}$RFLPLPGLPPALPEPPGILAPQPPDVGSSDPL$X_{167}$MV$X_{170}X_{171}$SQ $X_{174}$RSPS$X_{179}X_{180}X_{181}$.

The N terminal HPIPDSS may be missing or partially missing; $X_{19}$ is selected from R, Y, $V_E$ or C; $X_{31}$ is selected from A or C; $X_{36}$ is selected from R or K; $X_{43}$ is selected from G or C; $X_{45}$ is selected from A, K, E or V; $X_{56}$ is selected from K, R, V or I; $X_{98}$ is selected from L, R or D; $X_{118}$ is selected from L or C; $X_{122}$ is selected from K or R; $X_{134}$ is selected from A or C; $X_{167}$ is selected from S, A or R; $X_{170}$ is selected from G or E; $X_{171}$ is selected from P or G; $X_{174}$ is selected from G, A or L; $X_{179}$ is selected from Y, A or F; $X_{180}$ is selected from A or E; $X_{181}$ is selected from S, K or is missing.

The FGF21 analogue is an active protein that has the same or similar biological function as native FGF21 (SEQ ID NO. 136) and shares a sequence identity above 80% with native FGF21 (SEQ ID NO. 136). Preferably, the FGF21 analogue shares a sequence identity above 85% with native FGF21 (SEQ ID NO. 136); More preferably, the FGF21 analogue shares a sequence identity above 90% with native FGF21 (SEQ ID NO. 136); More preferably, the FGF21 analogue shares a sequence identity above 95% with native FGF21 (SEQ ID NO. 136). Preferably, the FGF21 analogue is shown in SEQ ID NO. 137-148.

$L_a$ does not exist or is a peptide linker, $L_b$ does not exist or is a peptide linker. When $L_a$ and $L_b$ are peptide linkers, the peptide linkers are the same as the $L_a$ in Embodiment 2.

Based on the GCGR/GLP-1R dual-agonist active protein, FGF21 or FGF21 analogue is fused at the C-terminal of $F_C$ by a peptide linker, to prepare the exemplary tri-agonist active proteins with amino acids as shown in SEQ ID NO.149-208 and nucleotides as shown in SEQ ID NO.263-322. The corresponding codes of the tri-agonist active protein are COO2L13F8L10W, C240 L12F8L12M1, C240 L9F7L13M2, C240 L13F4L9M1, C240 L9F2L13M3, C240 L13F10L9M2, C225 L10F10L14M2, C163 L13F8L13M2, C271 L9F4L8M2, C368 L10F4L10M2, C495 L13F8L13M1, C495 L13F8L10M2, C495 L9F10L9M1, C353 L13F3L10M4, C352 L13F4L9M3, C382 L9F3L9M2, C382 L10F2L13M2, C382 L13F10L9M1, C382 L13F8L10M2, C382 L12F7L9M2, C382 L14F4L9M2, C232 L9F3L10M3, C227 L12F5L14M4, C266 L13F7L13M4, C137 L10F8L9M5, C399 L12F4L19M8, C392 L11F7L10M5, C462 L9F2L9M10, C462 L10F5L10M3, C462 L11F8L13M1, C462 L13F4L10M2, C462 L13F8L10M2, C462 L13F10L9M4, C228 L13F4L13M12, C187 L9F4L12M7, C364 L10F4L12M8, C209 L13F8L13M9, C289 L12F4L8M10, C611 L11F4L11M11, C618 L13F7L13M1, C618 L12F4L12M2, C623 L9F3L10M1, C623 L9F8L9M2, C627 L12F10L9M6, C654 L13F9L6M3, C673 L8F3L8M8, C563 L14F8L9M3, C549 L12F4L9M4, C555 L10F6L12M1, C487 L13F7L13M4, C488 L9F9L9M2, C498 L13F4L13M4, C503 L15F2L9M5, C508 L7F4L9M3, C711 L13F5L10M4, C708 L10F4L14M7, C743 L18F7L8M10, C756 L20F4L10M8, C788 L1F5L5M5 and C731 L5F2L9M9, respectively.

A-$L_a$-F-$L_b$-B can be prepared by the skilled in the art using the existing technologies on the basis of knowing the amino acid sequence. Due to the presence of $F_C$ sequence, Protein A resin chromatography with high affinity and high specificity can be used for protein purification. The specific method may refer to the preparation method in Embodiment 2. Purified recombinant proteins were performed on SDS-PAGE electrophoresis or amino acid sequence verification, and the results were consistent with expectations. FIG. 1 indicates SDS-PAGE results of some purified samples.

Embodiment 4

Preparation of FGF21 Analogues Fused with $F_C$

In this Embodiment, an $F_C$ (code: F9) is fused with the native FGF21 and an FGF21 analogue (code: $M_1$-$M_{12}$) to obtain a long-acting FGF21 analogue. The structure of the long-acting FGF21 analogue is shown as: F-$L_b$-B. F may be selected from a complete $F_C$ portion of an immunoglobulin, a fragment of an $F_C$ portion of an immunoglobulin, or a mutant of an $F_C$ portion of an immunoglobulin. The amino acid sequence of F may be shown in any one of SEQ ID NO. 9-18. $L_b$ does not exist or is a peptide linker. When $L_b$ is a peptide linker, the peptide linker is the same as the $L_a$ in Embodiment 2.

The peptide linker includes units rich in G, S and/or A, for example, (GS)n, (GGS)n, (GGSG)n, (GGGS)nA, (GGGGS)nA, (GGGGA)nA, and n is an integer of 1-10. In a preferred embodiment, the amino acid length of the peptide linker is 5-26. Further, the amino acid sequence of the peptide linker may be shown in any one of SEQ ID NO. 19-41. The B is native FGF21 (SEQ ID NO. 136) or FGF21 analogue. The B is the same as the B in Embodiment 3.

The amino acid sequence of the long-acting FGF21 analogue may be as shown in SEQ ID NO.209-221, respectively, the codes are F9L10W, F9L10M1, F9L10M2, F9L10M3, F9L10M4, F9L10M5, F9L10M6, F9L10M7, F9L10M8, F9L10M9, F9L10M9, F9L10M11 and F9L10M12, respectively. Synthesizing DNAs according to the protein sequences and subcloning the DNAs into a recombinant expression vector is a conventional method in the technical field, and the transfection of Hek293F cells and cell expression are the same as in Embodiment 2. Similarly, due to the presence of the $F_C$ sequence, the separation and purification process may also refer to Embodiment 2.

Embodiment 5

In Vitro Cell-Based Bioactivity Assay

The dual-agonist active proteins obtained in Embodiment 2 were subjected to in vitro cell-based bioactivity assays, including GLP-1R agonist activity assay and GCGR agonist activity assay.

GLP-1R Agonist Activity Assay:

A luciferase reporter assay was used to determine the in vitro GLP-1R agonist activity (Jonathan W Day et al.: Nat Chem Biol. 2009 October; 5 (10): 749-57). A human GLP-1R gene was cloned into the mammalian cell expression plasmid pCDNA3.1 to construct a recombinant expression plasmid pCDNA3.1-GLP-1R, and the full-length luciferase gene was cloned into pCRE plasmid to obtain a pCRE-Luc recombinant plasmid. CHO cells were transfected with pCDNA3.1-GLP-1R and pCRE-Luc plasmids at a molar ratio of 1:10, and stably transfected strains were selected to obtain recombinant CHO/GLP-1R stably transfected cell strains.

Cells were cultured using DMEM/F12 medium containing 10% FBS and 300 μg/ml G418 in a 9-cm cell culture dish. When the cells reached about 90% confluence, the supernatant was discarded. 2ml Trypsin was added to digestion for 3min was added for digestion for 3min followed by addition of 2 ml DMEM/F12 medium containing 10% FBS and 300 μg/ml G418 for neutralizing. After transferring to a 15 ml centrifuge tube, the cells were centrifuged at 1000 rpm for 5 min and the supernatant was discarded, followed by addition of 2 ml DMEM/F12 medium containing 10% FBS and 300 μg/ml G418 for resuspending, and finally counted. The cells were diluted to $3\times10^5$ per ml with DMEM/F12 medium containing 10% FBS and aliquots of 100 ul were seeded into each well of a 96-well plate, i.e. $5\times10^4$ per well. The cells were cultured in DMEM/F12 medium containing 0.2% FBS after adherence. After discarding the supernatant of the cells in the 96-well plate, the purified recombinant proteins (Table 1, Table 2) or native Glucagon (Hangzhou Chinese Peptide Biochemical Co., Ltd, GLUC-004) and native GLP-1 (Hangzhou Chinese Peptide Biochemical Co., Ltd., GLUC-016B) as positive controls were diluted with DMEM/F12 medium containing 0.1% FBS to a series of specified concentrations, followed by addition to cell culture (100,11/well). Luciferase signal was recorded after stimulating for 6h. The determination was carried out according to the instructions of Luciferase reporter kit (Ray Biotech, Cat: 68-LuciR-S200).

GCGR Agonist Activity Assay:

The luciferase reporter assay was also used in determination of GCGR agonist activity. The GCGR gene is cloned into mammalian cell expression plasmid pCDNA3.1 to construct a recombinant expression plasmid pCDNA3.1-GCGR. The recombinant expression plasmid pCDNA3.1-GCGR is co-transfected with the pCRE-Luc recombinant plasmid into HEK 293T cells, and the stably transfected cell strains HEK 293T/GCGR are screened and constructed.

FGF21 Activity Assay:

The assay for FGF21 activity determination was performed using similar methods as in the literature with some proper modifications (Xu J etc., Polyethylene glycol modified FGF21 engineered to maximize potency and minimize vacuole formation, Bioconjug Chem.; 24 (6): 915-25, 2013). The puromycin resistance gene pac was amplified by PCR and cloned into pcDNA3.1(+) to replace the original G418 resistance gene. The GAL4DBD-ELK1, IRES, and KLB (β-klotho) genes were amplified by PCR and cloned into the pcDNA-Puro plasmid in sequence to construct the plasmid pcDNA-GAL4DBD-ELK1-IRES-KLB-Puro for cell transfection and screening. The plasmid was extracted by OMEGA E.Z.N.A.® Endo-Free Plasmid Midi Kit. The process of cell transfection was as follows: Hek293T cells were plated in a 6-well plate, $3\times10^5$ cells per well, and cultured overnight.

The cells were washed twice with Opti-MEM medium, followed by addition of 2 ml Opti-MEM medium. Mixture for cell transfection was prepared according to the following proportion: Lipofectamine 2000 (6 μl): pFR-Luc (4.6 μg): pcDNA-GAL4DBD-ELK1-IRES-KLB-Puro (1 μg). The mixture was slowly added to a 6-well plate and mixed well after incubation for 20 minutes. After culturing for 6 h, the medium was replaced with DMEM medium plus 10% FBS, followed by culturing at 37° C. with 5% $CO_2$. Screening was performed to obtain stably transfected cell strains respond to FGF21 stimulation. When full confluence in the dish was observed, the cells were digested with Trypsin to prepare a cell suspension ($1\times10^5$ cells/ml, DMEM +5% FBS +1 μg/ml puromycin), followed by plating in a 96-well plate (100 μl per well) and culturing overnight. Fluorescence signals were recorded using the Luciferase Reporter Assay Kit (68-LucifR-5200) after samples with gradient concentrations were added for stimulation for 6 h.

The results of the activity assays of some dual-agonist active proteins are shown in Table 1 and Table 2:

TABLE 1

| Codes of dual-agonist active proteins | SEQ ID NO. | $EC_{50}$ (nM) GCGR | GLP-1R | GLP-1R agonist activity ratio [a] |
|---|---|---|---|---|
| C001L$_{13}$F$_8$ | 93 | 7.98 | 380.32 | 27 |
| C002L$_{13}$F$_8$ | 94 | 8.16 | 13.89 | |
| CG283L$_{13}$F$_8$ | 95 | 1.24 | 330.41 | 215 |
| C240L$_{13}$F$_8$ | 96 | 1.45 | 1.54 | |
| CG214L$_{13}$F$_8$ | 97 | 1.12 | 360.49 | 206 |
| C382L$_{13}$F$_8$ | 98 | 1.33 | 1.75 | |
| CG267L$_{13}$F$_8$ | 99 | 1.15 | 360.87 | 214 |
| C276L$_{13}$F$_8$ | 100 | 1.23 | 1.69 | |
| C308L$_{13}$F$_8$ | 101 | 1.09 | 409.20 | 244 |
| C368L$_{13}$F$_8$ | 102 | 1.51 | 1.68 | |
| C224L$_{13}$F$_8$ | 103 | 1.11 | 335.2 | 211 |
| C225L$_{13}$F$_8$ | 104 | 1.36 | 1.59 | |
| CG308L$_{13}$F$_8$ | 105 | 1.16 | 350.22 | 237 |
| C495L$_{13}$F$_8$ | 106 | 1.50 | 1.48 | |
| C319L$_{13}$F$_8$ | 107 | 1.44 | 378.12 | 209 |
| C364L$_{13}$F$_8$ | 108 | 1.57 | 1.81 | |
| C214L$_{13}$F$_8$ | 109 | 0.97 | 437.83 | 226 |
| C232L$_{13}$F$_8$ | 110 | 1.34 | 1.94 | |
| C303L$_{13}$F$_8$ | 111 | 1.03 | 389.12 | 224 |
| C392L$_{13}$F$_8$ | 112 | 1.67 | 1.74 | |
| CG303L$_{13}$F$_8$ | 113 | 1.19 | 452.48 | 214 |
| C462L$_{13}$F$_8$ | 114 | 1.38 | 2.11 | |
| Glucagon | 42 | | | 1.4[b] |
| Glucagon Cex | 43 | | | |
| Glucagon | 42 | | | 2.3[c] |
| Glucagon Cex | 43 | | | |

Notes: The codes of proteins in table are named in accordance with the following rules: polypeptide code+ peptide linker code +F$_C$ code. For example, C240L$_{13}$F$_4$ indicates that the C240 polypeptide is fused with an IgG F$_C$ codenamed F$_4$) via a peptide linker codenamed L$_{13}$.

a is the ratio of GLP-1R agonist activity before and after the insertion of GPSSGAPPPS (SEQ ID NO: 3) or similar sequence (also known as sequence Cex, selected from SEQ ID NO.3-8 in the present disclosure) between the GCG analogue and the Fc.

b is the ratio calculated based on the GLP-1R agonist activity of native Glucagon and Glucagon Cex disclosed in Table 2 of U.S. Pat. No. 9,018,164 B2.

c is the ratio calculated based on the GLP-1R agonist activity of native Glucagon and Glucagon Cex disclosed in Table 1 in a paper of Joseph r. Chabenne et al. (Joseph R. Chabenne etc., Optimization of the Native Glucagon Sequence for Medicinal Purposes, J Diabetes Sci Technol. 4(6): 1322-1331, 2010).

As shown in Table 1 and Table 2, when a sequence containing Cex (selected from SEQ ID NO.3-8 in the present disclosure) is fused with F (SEQ ID NO.16) via (GGG-GS)$_3$A (SEQ ID NO.31) to form a dimer, the GLP-1R agonist activity is increased by more than 200 times, while the GCGR agonist activity shows no significant change.

TABLE 2

| Codes of dual-effect active proteins | SEQ ID NO. | EC$_{50}$(nM) GCGR | GLP-1R |
|---|---|---|---|
| C240L$_{12}$F$_8$ | 115 | 1.33 | 1.46 |
| C368L$_{10}$F$_4$ | 116 | 1.42 | 1.72 |
| C364L$_{10}$F$_4$ | 117 | 1.48 | 1.65 |
| C352L$_{13}$F$_4$ | 118 | 1.23 | 1.75 |
| C225L$_{10}$F$_{10}$ | 119 | 1.39 | 1.47 |
| C228L$_{13}$F$_4$ | 120 | 1.52 | 1.81 |
| C187L$_9$F$_4$ | 121 | 1.20 | 1.53 |
| C618L$_{12}$F$_4$ | 122 | 1.27 | 1.32 |
| C623L$_9$F$_3$ | 123 | 1.17 | 1.26 |
| C228L$_{13}$F$_4$ | 124 | 1.51 | 1.87 |
| C498L$_{13}$F$_4$ | 125 | 1.88 | 2.01 |
| C503L$_{15}$F$_2$ | 126 | 1.78 | 2.13 |
| C508L$_7$F$_4$ | 127 | 1.45 | 1.77 |
| C756L$_{20}$F$_4$ | 128 | 21.23 | 13.70 |
| C788L$_1$F$_5$ | 129 | 26.66 | 18.54 |
| C289L$_{12}$F$_4$ | 130 | 2.01 | 2.54 |
| C611L$_{11}$F$_4$ | 131 | 1.19 | 1.32 |
| C209L$_{13}$F$_8$ | 132 | 1.63 | 2.41 |
| C627L$_{13}$F$_{10}$ | 133 | 1.27 | 1.41 |

Results of Activity Assay of Tri-Agonist Active Proteins

The activity results of the tri-agonist active proteins prepared in Embodiment 3 are shown in Table 3:

TABLE 3

| Codes of active proteins | Amino acid sequence (SEQ ID NO.) | GCGR agonist activity (EC$_{50}$, nM) | GLP-1R agonist activity (EC$_{50}$, nM) | FGF21 activity (EC$_{50}$, nM) |
|---|---|---|---|---|
| Native Glucagon | 42 | 0.94 | 120.87 | |
| Native GLP-1 | 1 | >1000 | 0.52 | |
| Native FGF21 | 136 | | | 0.12 |
| C002L13F8L10W | 149 | 1.22 | 1.34 | 0.55 |
| C240 L12F8L12M1 | 150 | 1.20 | 1.13 | 0.79 |
| C240 L9F7L13M2 | 151 | 1.30 | 1.17 | 0.83 |
| C240 L13F4L9M1 | 152 | 1.16 | 1.26 | 0.77 |
| C240 L9F2L13M3 | 153 | 1.34 | 1.31 | 1.36 |
| C240 L13F10L9M2 | 154 | 1.25 | 1.21 | 0.89 |
| C225 L10F10L14M2 | 155 | 1.17 | 1.42 | 0.85 |
| C163 L13F8L13M2 | 156 | 1.37 | 1.28 | 0.93 |
| C271 L9F4L8M2 | 157 | 1.18 | 1.33 | 0.87 |
| C368 L10F4L10M2 | 158 | 1.25 | 1.30 | 0.74 |
| C495 L13F8L13M1 | 159 | 1.13 | 1.33 | 0.82 |
| C495 L13F8L10M2 | 160 | 1.21 | 1.30 | 0.71 |
| C495 L9F10L9M1 | 161 | 1.43 | 1.21 | 0.84 |
| C353 L13F3L10M4 | 162 | 1.11 | 1.36 | 1.67 |
| C352 L13F4L9M3 | 163 | 1.15 | 1.21 | 1.45 |
| C382 L9F3L9M2 | 164 | 1.35 | 1.18 | 0.81 |
| C382 L10F2L13M2 | 165 | 1.21 | 1.19 | 0.87 |
| C382 L13F10L9M1 | 166 | 1.27 | 1.13 | 0.76 |
| C382 L13F8L10M2 | 167 | 1.33 | 1.21 | 0.91 |
| C382 L12F7L9M2 | 168 | 1.42 | 1.30 | 0.88 |
| C382 L14F4L9M2 | 169 | 1.22 | 1.25 | 0.76 |
| C232 L9F3L10M3 | 170 | 1.45 | 1.79 | 0.65 |
| C227 L12F5L14M4 | 171 | 1.38 | 1.55 | 0.71 |
| C266 L13F7L13M4 | 172 | 1.34 | 1.37 | 0.69 |
| C137 L10F8L9M5 | 173 | 1.77 | 1.79 | 0.78 |
| C399 L12F4L19M8 | 174 | 1.82 | 1.89 | 0.96 |
| C392 L11F7L10M5 | 175 | 1.46 | 1.67 | 0.85 |
| C462 L9F2L9M10 | 176 | 1.34 | 1.21 | 1.54 |
| C462 L10F5L10M3 | 177 | 1.22 | 1.23 | 1.37 |
| C462 L11F8L13M1 | 178 | 1.17 | 1.41 | 0.78 |
| C462 L13F4L10M2 | 179 | 1.27 | 1.32 | 0.88 |
| C462 L13F8L10M2 | 180 | 1.63 | 1.21 | 0.58 |
| C462 L13F10L9M4 | 181 | 1.23 | 1.11 | 1.33 |
| C228 L13F4L13M12 | 182 | 1.38 | 1.27 | 1.37 |
| C187 L9F4L12M7 | 183 | 1.69 | 1.88 | 0.79 |
| C364 L10F4L12M8 | 184 | 1.27 | 1.87 | 0.73 |
| C209 L13F8L13M9 | 185 | 1.45 | 1.74 | 1.13 |
| C289 L12F4L8M10 | 186 | 1.38 | 1.77 | 1.36 |
| C611 L11F4L11M11 | 187 | 1.39 | 1.10 | 1.73 |
| C618 L13F7L13M1 | 188 | 1.25 | 1.47 | 0.68 |
| C618 L12F4L12M2 | 189 | 1.32 | 1.53 | 0.78 |
| C623 L9F3L10M1 | 190 | 1.56 | 1.88 | 0.74 |
| C623 L9F8L9M2 | 191 | 1.45 | 1.93 | 0.88 |
| C627 L12F10L9M6 | 192 | 1.69 | 1.48 | 1.11 |
| C654 L13F9L6M3 | 193 | 1.25 | 1.53 | 0.71 |
| C673 L8F3L8M8 | 194 | 1.44 | 1.92 | 1.01 |
| C563 L14F8L9M3 | 195 | 1.25 | 1.53 | 0.77 |
| C549 L12F4L9M4 | 196 | 1.44 | 1.92 | 0.80 |
| C555 L10F6L12M1 | 197 | 1.22 | 1.37 | 0.60 |
| C487 L13F7L13M4 | 198 | 1.47 | 1.33 | 0.89 |
| C488 L9F9L9M2 | 199 | 1.34 | 1.71 | 0.73 |
| C498 L13F4L13M4 | 200 | 2.30 | 2.28 | 0.83 |
| C503 L15F2L9M5 | 201 | 3.24 | 4.36 | 0.91 |
| C508 L7F4L9M3 | 202 | 3.38 | 5.45 | 0.67 |
| C711 L13F5L10M4 | 203 | 9.55 | 10.81 | 0.75 |
| C708 L10F4L14M7 | 204 | 5.61 | 9.56 | 1.67 |
| C743 L18F7L8M10 | 205 | 7.34 | 6.67 | 1.36 |
| C756 L20F4L10M8 | 206 | 6.49 | 8.82 | 0.96 |
| C788 L1F5L5M5 | 207 | 7.64 | 10.61 | 0.88 |
| C731 L5F2L9M9 | 208 | 6.57 | 9.65 | 1.08 |
| F9 L10W | 209 | | | 0.48 |
| F9 L10M2 | 211 | | | 0.71 |

The codes of proteins in the table are in accordance with the following rules: polypeptide code+peptide linker code+F$_C$ code+peptide linker code+FGF21 mutant code. For example, C209L$_{13}$F$_4$L$_{13}$M$_9$ indicates that the C209 polypeptide is fused with an IgG F$_C$ codenamed F$_4$ via a peptide linker codenamed L$_{13}$, and further fused with an FGF21 mutant codenamed M$_9$ via a peptide linker codenamed L$_{13}$.

Embodiment 6

Stability Study of the Tri-Agonist Active Proteins in Presence of DPP-IV

The purified tri-agonist active proteins were dissolved in 10 mM HEPES buffer (containing 0.05 mg/ml BSA) at a final concentration of 5 uM.

Recombinant protease DPP-IV was added (final concentration of 10 nM), and in-vitro GCGR agonist activity was determined after bathing at 37° C. for 24 hours. Percentage of residual activity=(activity after DPP-IV treatment/activity before DPP-IV treatment) ×100%.

In this Embodiment, GCG analogues with an unnatural amino acid Aib or D-Ser introduced at the second position were used as controls:

GD$_{Ser}$GS:

(SEQ ID NO. 134)
H-D-Ser-QGTFTSDYSKYLDSQAAQDFVQWLMNGGPSSGAPPPS;

G$_{Aib}$GS:

(SEQ ID NO. 135)
H-Aib-QGTFTSDYSKYLDSQAAQDFVQWLMNGGPSSGAPPPS;

C364 (SEQ ID NO.70), C382 (SEQ ID NO.57), C495 (SEQ ID NO.53), C462 (SEQ ID NO.66), C225 (SEQ ID NO.47) and C209 (SEQ ID NO.71) serve as controls for the stability study in this embodiment.

The results are shown in Table 4:

TABLE 4

| Codes of active proteins | Activity preservation rate (%) | Codes of active proteins | Activity preservation rate (%) |
|---|---|---|---|
| C001$L_{13}F_8$ | 3.2 | C228 $L_{13}F_4L_{13}M_{12}$ | 91.4 |
| C002$L_{13}F_8$ | 2.9 | C187 $L9F_4L_{12}M_7$ | 95.7 |
| C002$L_{13}F_8 L_{10}W$ | 3.8 | C364 $L_{10}F_4L_{12}M_8$ | 90.6 |
| C240 $L_{12}F_8L_{12}M_1$ | 98.9 | C209 $L_{13}F_8L_{13}M_9$ | 91.1 |
| C240 $L_9F_7L_{13}M_2$ | 98.4 | C289 $L_{12}F_4L_8M_{10}$ | 93.3 |
| C240 $L_{13}F_4L_9M_1$ | 94.7 | C611 $L_{11}F_4L_{11}M_{11}$ | 97.5 |
| C240 $L_9F_2L_{13}M_3$ | 96.1 | C618 $L_{13}F_7L_{13}M_1$ | 92.7 |
| C240 $L_{13}F_{10}L_9M_2$ | 97.7 | C618 $L_{12}F_4L_{12}M_2$ | 89.4 |
| C225 $L_{10}F_{10}L_{14}M_2$ | 89.2 | C623 $L_9F_3L_{10}M_1$ | 95.6 |
| C163 $L_{13}F_8L_{13}M_2$ | 97.3 | C623 $L_9F_8L_9M_2$ | 97.6 |
| C271 $L_9F_4L_8M_2$ | 96.0 | C627 $L_{12}F_{10}L_9M_6$ | 95.6 |
| C368 $L_{10}F_4L_{10}M_2$ | 97.9 | C654 $L_{13}F_6L_6M_3$ | 93.3 |
| C495 $L_{13}F_8L_{13}M_1$ | 96.9 | C673 $L_8F_3L_8M_8$ | 96.1 |
| C495 $L_{13}F_8L_{10}M_2$ | 99.3 | C563 $L_{14}F_8L_9M_3$ | 95.4 |
| C495 $L_9F_{10}L_9M_1$ | 95.6 | C549 $L_{12}F_4L_9M_4$ | 97.5 |
| C353 $L_{13}F_3L_{10}M_4$ | 94.5 | C555 $L_{10}F_6L_{12}M_1$ | 88.3 |
| C352 $L_{13}F_4L_9M_3$ | 98.7 | C487 $L_{13}F_7L_{13}M_4$ | 98.7 |
| C382 $L_9F_3L_9M_2$ | 96.6 | C488 $L_9F_9L_9M_2$ | 99.1 |
| C382 $L_{10}F_2L_{13}M_2$ | 95.8 | C498 $L_{13}F_4L_{13}M_4$ | 87.9 |
| C382 $L_{13}F_{10}L_9M_1$ | 97.8 | C503 $L_{15}F_2L_9M_5$ | 95.6 |
| C382 $L_{13}F_8L_{10}M_2$ | 99.3 | C508 $L_7F_4L_9M_3$ | 97.2 |
| C382 $L_{12}F_7L_9M_2$ | 96.9 | C711 $L_{13}F_5L_{10}M_4$ | 95.9 |
| C382 $L_{14}F_4L_9M_2$ | 94.9 | C708 $L_{10}F_4L_{14}M_7$ | 90.5 |
| C232 $L_9F_3L_{10}M_3$ | 98.2 | C743 $L_{18}F_7L_8M_{10}$ | 99.0 |
| C227 $L_{12}F_5L_{14}M_4$ | 91.9 | C756 $L_{20}F_4L_{10}M_8$ | 94.9 |
| C266 $L_{13}F_7L_{13}M_4$ | 88.2 | C788 $L_1F_5L_5M_5$ | 96.5 |
| C137 $L_{10}F_8L_9M_5$ | 96.8 | C731 $L_5F_2L_9M_9$ | 98.6 |
| C399 $L_{12}F_4L_{19}M_8$ | 87.3 | $G_{4ib}GS$ | 98.7 |
| C392 $L_{11}F_7L_{10}M_5$ | 94.5 | $GD_{Ser}GS$ | 99.2 |
| C462 $L_9F_2L_9M_{10}$ | 93.8 | C364 | 7.5 |
| C462 $L_{10}F_5L_{10}M_3$ | 96.4 | C382 | 6.8 |
| C462 $L_{11}F_8L_{13}M_1$ | 95.7 | C495 | 9.2 |
| C462 $L_{13}F_4L_{10}M_2$ | 92.2 | C462 | 4.3 |
| C462 $L_{13}F_8L_{10}M_2$ | 97.9 | C225 | 5.8 |
| C462 $L_{13}F_{10}L_9M_4$ | 93.7 | C209 | 8.9 |

Embodiment 7

Stability Study of the Tri-Agonist Active Proteins in Serum

In-Vitro Cell-Based Bioactivity Assay:

(1) Tri-agonist active proteins were concentrated by ultra-filtration and diluted with 2 0mM PB (pH7.4) to 1.6 mg/ml. After sterilization and filtration, the proteins were diluted with serum (FBS, GEMINI 900-108, A97E00G) 10 times, mixed and divided into sterile centrifuge tubes;

(2) Glucagon (SEQ ID NO: 42, Hangzhou Chinese Peptide Biochemical Co., Ltd, GLUC-004) was diluted to 0.2 mg/ml. After sterilization and filtration, the diluted Glucagon was further diluted with serum as above 10 times, mixed and divided into sterile centrifuge tubes;

(3) One or two tubes of the above samples were stored at −20 ° C. as controls; the other tubes were incubated at a 37° C. At different time points, samples were selected to detect GCGR agonist activity;

(4) HEK 293T/GCGR cells were subcultured twice and then plated in a 96-well plate for sample activity determination. The residual activity was obtained by taking the activity at 0 hour as 100%, and comparing the activity measured at subsequent time points with that at 0 hour.

Figure 2A:
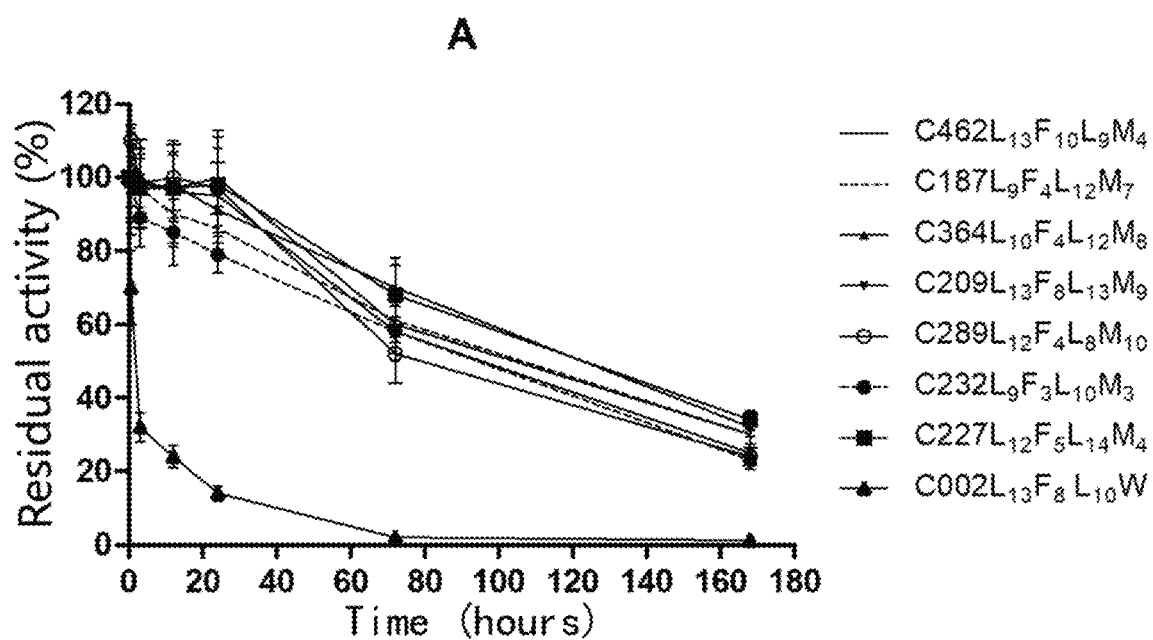
FIG. 2A: the resulting graph of serum stability over time.
Figure 2B:
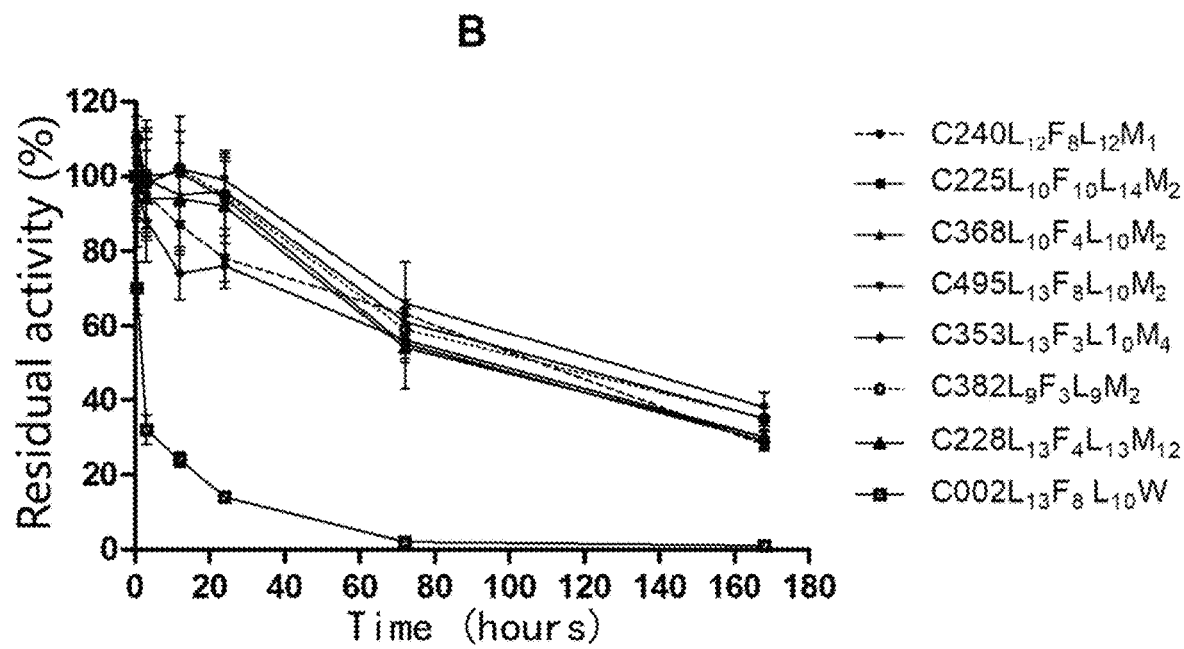
FIG. 2B: the resulting graph of serum stability over time.
Figure 2C:
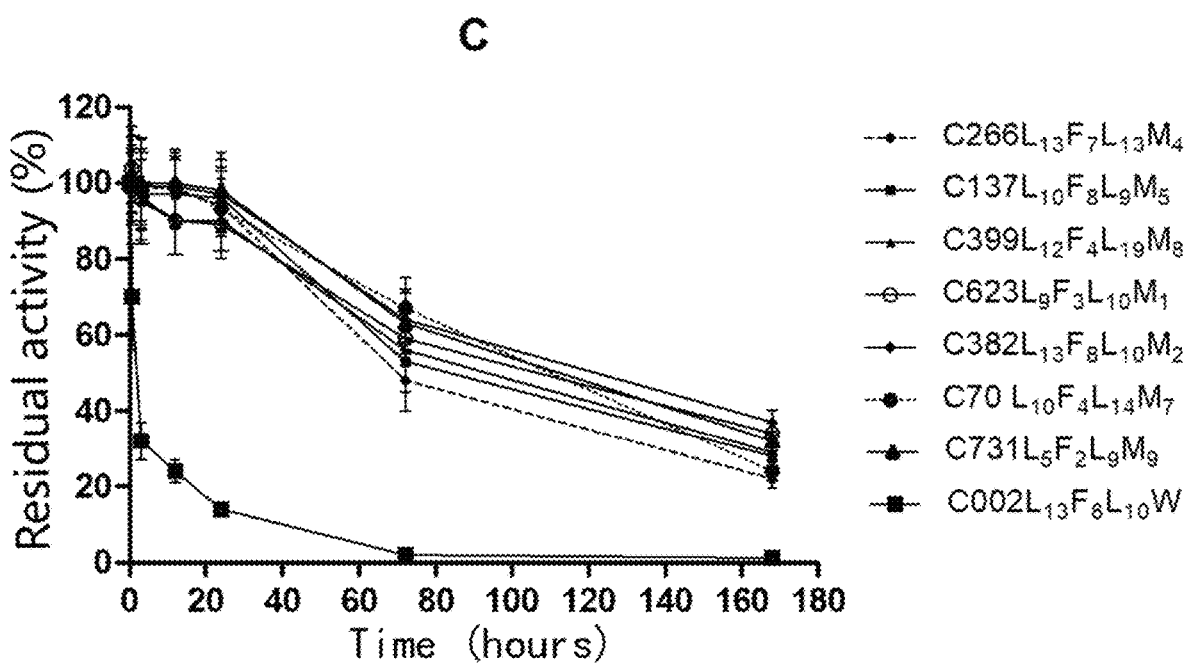
FIG. 2C: the resulting graph of serum stability over time.

Except for C002$L_{13}F_4L_{13}W$, the results of stability study in serum are similar to those in Table 4, there is no significant difference in stability among the tri-agonist active proteins. The relative activity of the exemplary tri-agonist active proteins over time is shown in FIGS. 2A-C.

Embodiment 8

Intraperitoneal Glucose Tolerance Test (IPGTT) in Normal ICR Mice

Figure 3:
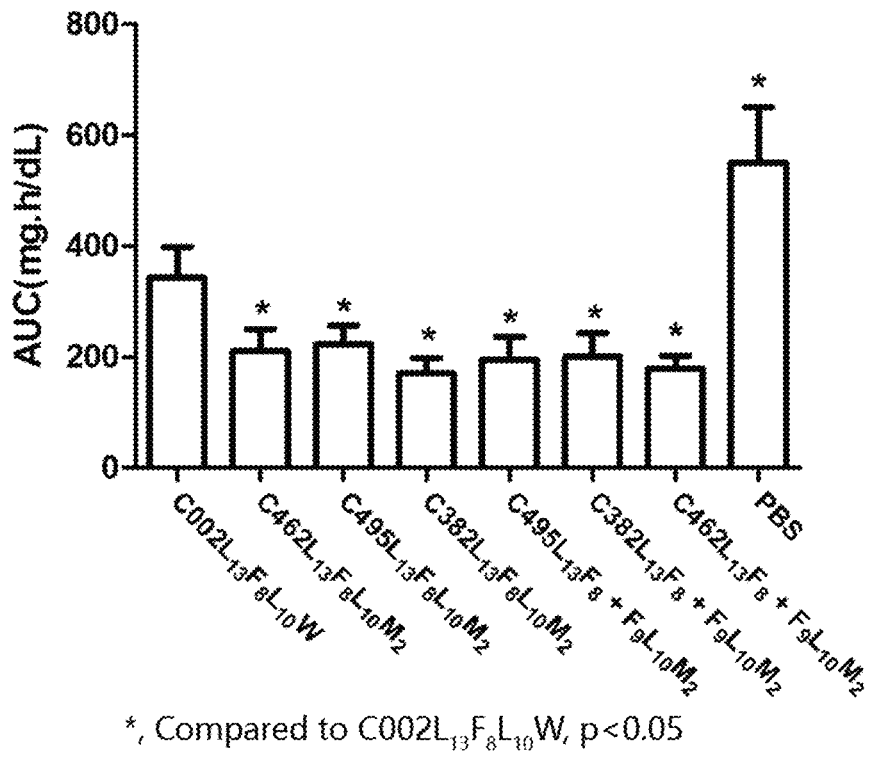
FIG. 3: the graph of the hypoglycemic effect of the active protein in Embodiment 8 on normal ICR mice.

Normal ICR mice were divided into several groups, 8 mice per group. Mice were fasted overnight followed by blood collection from the tail (sample marked as t=0 min blood glucose) and subcutaneously injection of the tri-agonist active proteins (40 nmol/kg, in acetate buffer), combined proteins (combination group) or saline PBS, respectively. The combination group was pre-mixed before administration (40 nmol/kg each, acetate buffer). Fifteen minutes after administration, glucose was injected intraperitoneally (2 g/kg of body weight) and blood glucose levels were recorded at t=30 min, t=60 min, t=120 min, and t=240 min. The animals kept fasted during the test period to prevent interference from food intake. The result is shown in FIG. 3.

Embodiment 9

Figure 4:
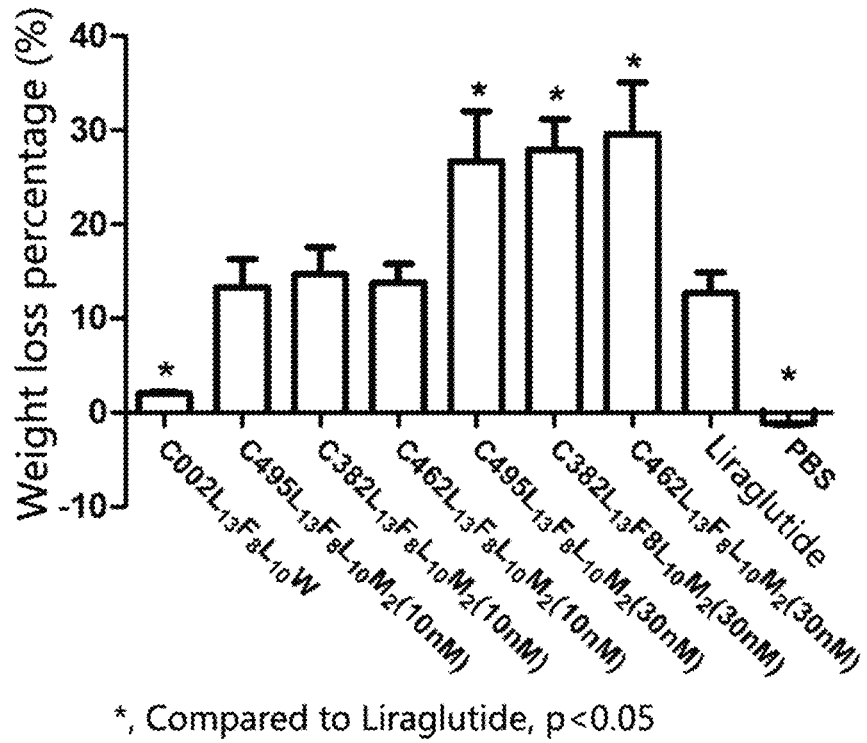
FIG. 4: the effect of the active protein in Embodiment 9 on the body weight of DIO mice.
Figure 5:
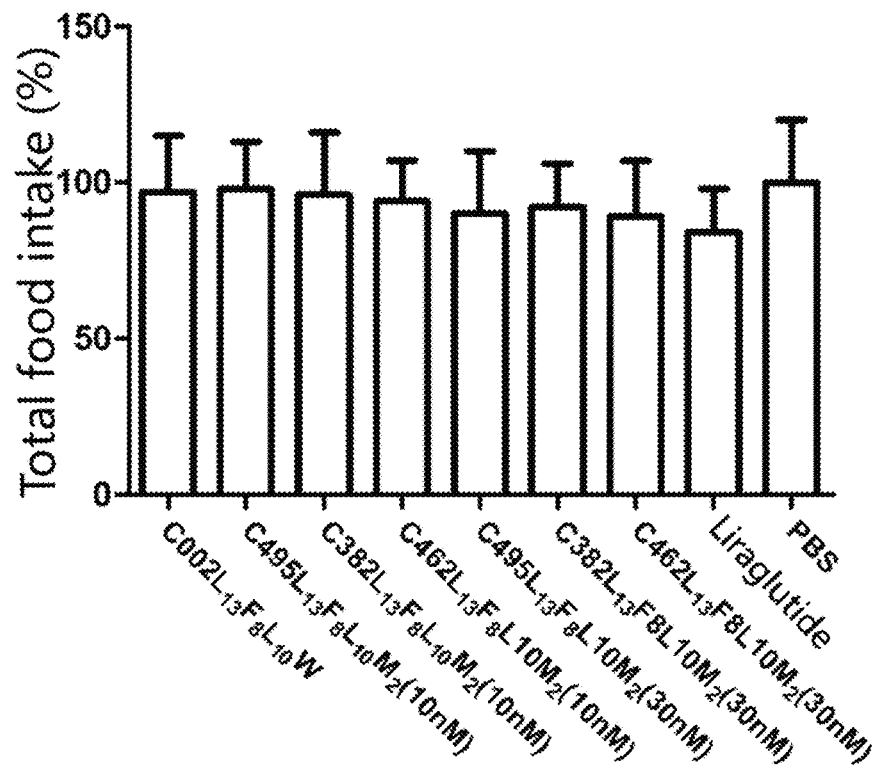
FIG. 5: the effect of the active protein in Embodiment 9 on the appetite of DIO mice; the food intake of the DIO mice in the PBS group is regarded as 100%, and the ordinate is the percentage of food intake in mice of groups compared with the DIO mice in the PBS group.

Pharmacodynamic Study of Continuous Administration of Tri-Agonist Active Proteins in Diet-Induced Obese (DIO) Mice 7-Week-old C57BL/6J male mice were fed a high-fat diet (60% kcal from fat) for another 16 weeks (a total of 23 weeks). The study was initiated when body weight of the mice reached approximate 55 g. Feeding conditions were as followed: 12 h light/12 h darkness, free food intake, single cage. Mice were grouped (8 mice per group) according to body weights and body weight growth curves the day before administration and administered subcutaneously at the next day. According to Table 5, the active proteins were administered at a dose of 10 nmol/kg of body weight or 30 nmol/kg of body weight once every 4 days. The negative control group was injected with saline (PBS) at 5 μl/kg of body weight. The positive control group was administered with Liraglutide (30 nmol/kg of body weight) once daily for 28 consecutive days. Body weight and food intake of mice were recorded every day. Mice were sacrificed 5 days after the last administration. Retro-orbital bleeding was performed. Plasma samples were frozen and stored at −80 ° C. Average weight change of animals before administration and sacrifice was calculated. The results of weight change are shown in FIG. 4. The change in total food intake is shown in FIG. 5.

TABLE 5

| Samples | SEQ ID NO. | Dose (nM) |
|---|---|---|
| C002$L_{13}F_8L_{10}W$ | 149 | 10 |
| C495 $L_{13}F_8L_{10}M_2$ | 160 | 10 |
| C382 $L_{13}F_8L_{10}M_2$ | 167 | 10 |
| C462 $L_{13}F_8L_{10}M_2$ | 180 | 10 |
| C495 $L_{13}F_8L_{10}M_2$ | 160 | 30 |
| C382 $L_{13}F_8L_{10}M_2$ | 167 | 30 |
| C462 $L_{13}F_8L_{10}M_2$ | 180 | 30 |

Embodiment 10

Figure 6:
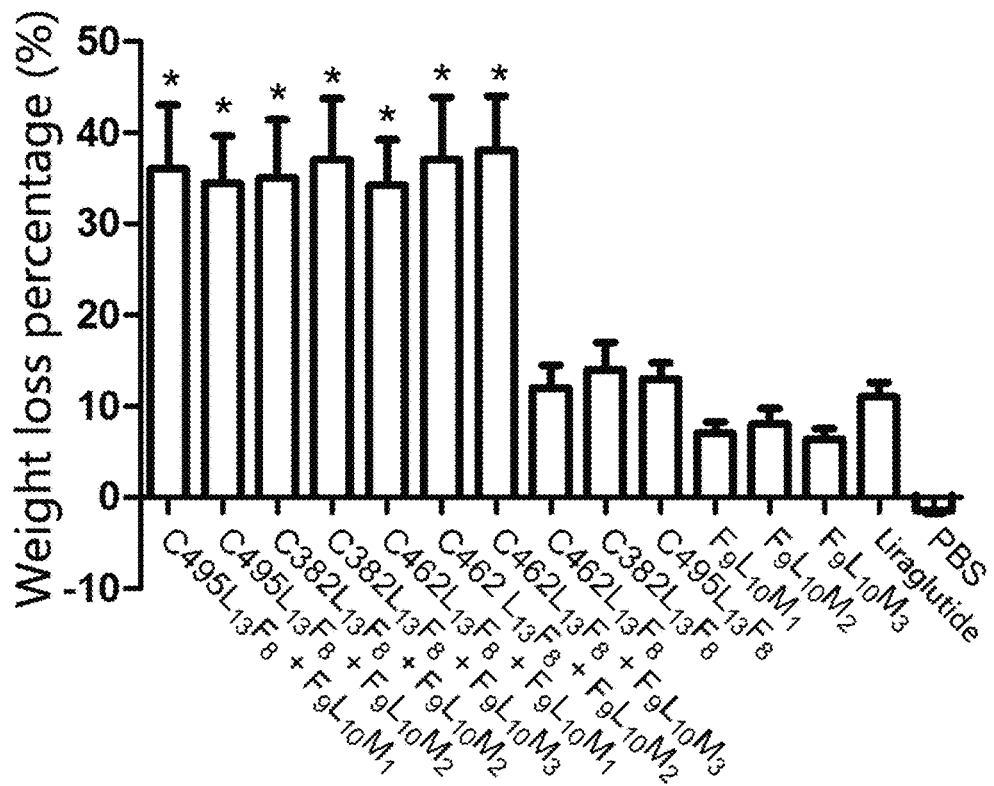
FIG. 6: the effect of the active protein in Embodiment 10 on the body weight of DIO mice.
Figure 7:
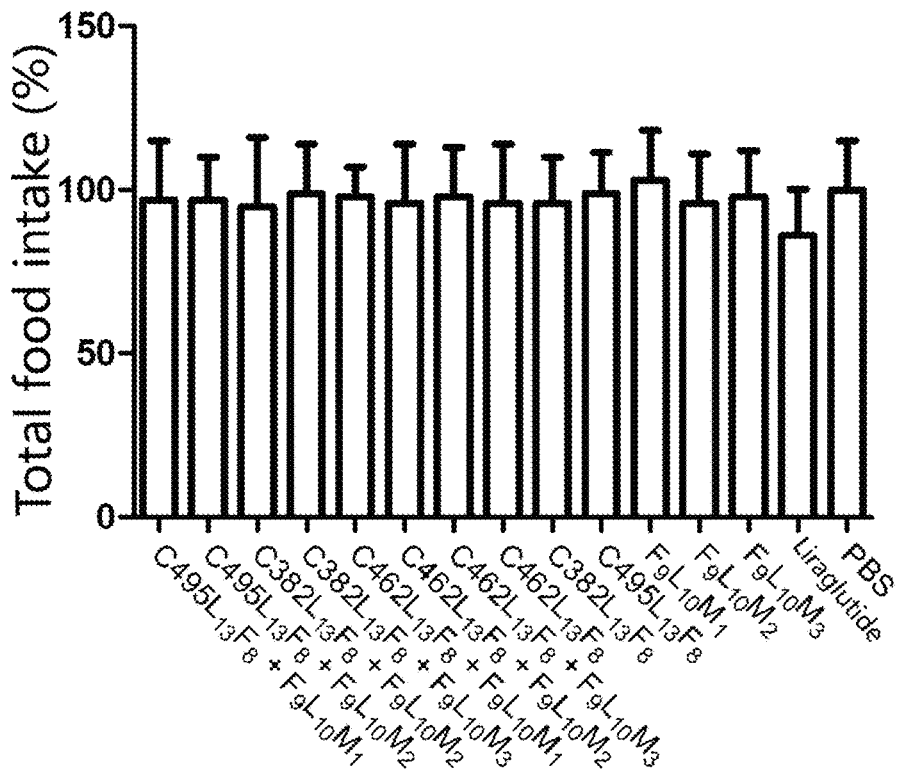
FIG. 7: the effect of the active protein in Embodiment 10 on the appetite of DIO mice; the food intake in DIO mice of PBS group is regarded as 100%, and the ordinate is the percentage of the food intake of mice in other groups compared with the DIO mice in the PBS group.

Pharmacodynamic Study of Combined Administration in Diet-Induced Obese (DIO) Mice The difference between this Embodiment and Embodiment 9 is that the dual-agonist active proteins and long-acting FGF21 analogues were co-administered as combination. 7-Week-old C57BL/6J male mice were fed a high-fat diet (60% kcal from fat) for another 16 weeks (a total of 23 weeks). The study was initiated when the body weight of the mice reached approximate 55g. Feeding conditions were as followed: 12 h light/12 h darkness, free food intake, single-cage; mice were grouped (8 mice per group) according to body weight and body weight growth curves the day before administration and administered subcutaneously at the next day. The dual-agonist active proteins and long-acting FGF21 analogues were mixed according to the dose information shown in Table 6 before administration. The administration was given at a dose of 15 nmol/kg of body weight or 30 nmol/kg of body weight once every 4 days. The negative control group was injected with saline (PBS) at 5 μl/kg of body weight. The positive control group was injected with Liraglutide (30 nmol/kg of body weight) and administered once a day for 28 consecutive days. The body weight and food intake of mice were measured every day. Mice were sacrificed 5 days after the last administration. Retro-orbital bleeding was performed. Plasma samples were frozen and stored at −80 ° C. Average weight change of animals before administration and sacrifice was calculated. The results of weight change are shown in FIG. 6. The change in total food intake is shown in FIG. 7.

TABLE 6

| Samples | SEQ ID NO. | Dose (nM) |
| --- | --- | --- |
| C495 $L_{13}F_8$ + $F_9L_{10}M_1$ | 106, 210 | 30 each |
| C495 $L_{13}F_8$ + $F_9L_{10}M_2$ | 106, 211 | 30 each |
| C382 $L_{13}F_8$ + $F_9L_{10}M_2$ | 98, 211 | 30 each |
| C382 $L_{13}F_8$ + $F_9L_{10}M_3$ | 98, 212 | 30 each |
| C462 $L_{13}F_8$ + $F_9L_{10}M_1$ | 114, 210 | 30 each |
| C462 $L_{13}F_8$ + $F_9L_{10}M_2$ | 114, 211 | 30 each |
| C462 $L_{13}F_8$ + $F_9L_{10}M_3$ | 114, 212 | 30 each |
| C462 $L_{13}F_8$ | 114 | 30 |
| C382 $L_{13}F_8$ | 98 | 30 |
| C495 $L_{13}F_8$ | 106 | 30 |
| $F_9L_{10}M_1$ | 210 | 30 |
| $F_9L_{10}M_2$ | 211 | 30 |
| $F_9L_{10}M_3$ | 212 | 30 |

Embodiment 11

Assay Method Development and Activity Determination of Tri-Agonist Active Proteins Structures of the tri-agonist active proteins of the present invention are shown in Embodiment 3. The fusion proteins C382L13F3L10M2 and C382L13F9L10M2 were prepared according to amino acids shown in SEQ ID NO.336 and SEQ ID NO.338, respectively, and their corresponding nucleotides are shown in SEQ ID NO.337 and SEQ ID NO.339, respectively.

The preparation method used in this Embodiment is the same as that in Embodiment 2.

The tri-agonist active proteins obtained in this Embodiment was subjected to in-vitro activity bioassays, including GLP-1R agonist activity bioassay, GCGR agonist activity bioassay and FGF21 activity bioassay. The assay method is the same as in Embodiment 5.

The results are shown in Table 7.

TABLE 7

| Codes of active proteins | Amino acid sequences (SEQ ID NO.) | GCGR agonist activity (EC$_{50}$, nM) | GLP-1R agonist activity (EC$_{50}$, nM) | FGF21 activity (EC$_{50}$, nM) |
| --- | --- | --- | --- | --- |
| Native Glucagon | 42 | 0.94 | 120.87 | |
| Native GLP-1 | 1 | >1000 | 0.52 | |
| Native FGF21 | 136 | | | 0.12 |
| C382L$_{13}$F$_3$L$_{10}$M$_2$ | 336 | 1.02 | 1.14 | 0.61 |
| C382L$_{13}$F$_9$L$_{10}$M$_2$ | 338 | 1.13 | 1.23 | 0.83 |

Embodiment 12

Stability Study of the Tri-Agonist Active Proteins in Serum

The tri-agonist active proteins obtained in Embodiment 11 were subjected to stability study in serum, and the assay method is the same as in Embodiment 7. The residual relative activity of the tri-agonist active proteins over time is shown in FIG. 8.

Figure 8:
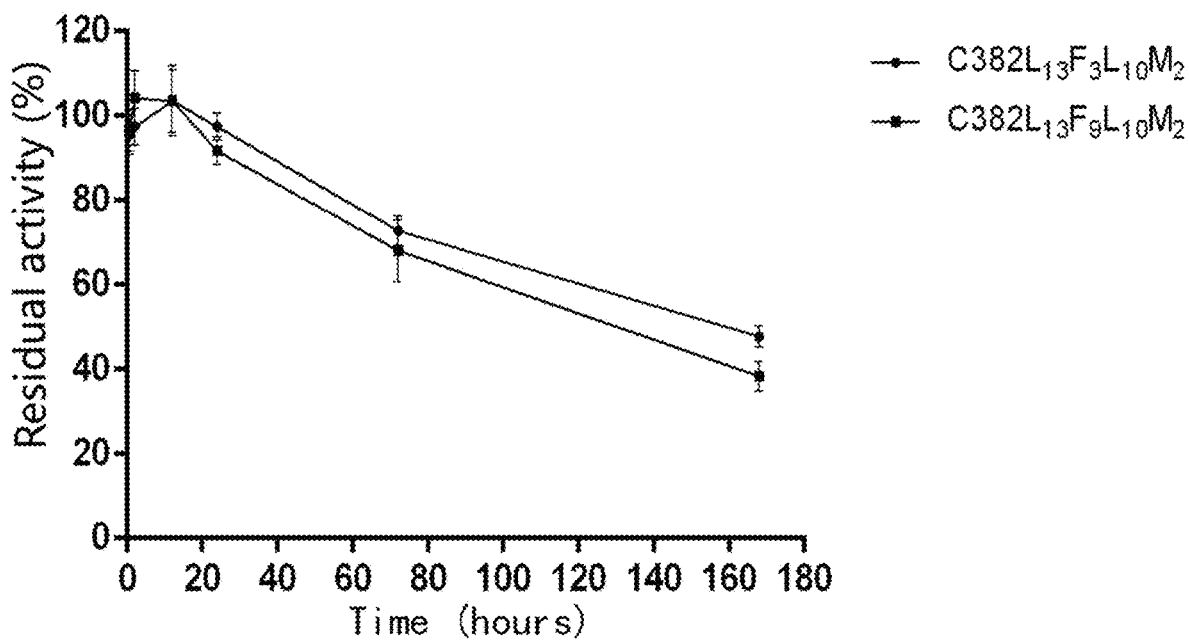
FIG. 8: the resulting graph of serum stability of the active protein in embodiment 11 over time.

FIG. 8 suggests that the tri-agonist active proteins showed improved residual activity after incubation for 7 days in serum, indicating a greatly improved stability compared with native GLP1 or Glucagon peptide.

Embodiment 13

Intraperitoneal Glucose Tolerance Ttest (IPGTT) in Normal ICR Mice

Normal ICR mice were divided into several groups, 8 mice per group. Mice were fasted overnight followed by blood collection from the tail (marked as t=0 min blood glucose sample), and subcutaneously injection of the tri-agonist active proteins (40 nmol/kg, acetate buffer) obtained in Embodiment 1, COO2L13F8L1OW (40 nmol/kg, acetate buffer) or PBS, respectively. Fifteen minutes later, glucose was injected intraperitoneally (2 g/kg of body weight) and blood glucose levels at t=30 min, t=60 min, t=120 min, and t=240 min were recorded. The animals kept fasted during the test period to prevent interference from food intake. The result is shown in FIG. 9.

Figure 9:
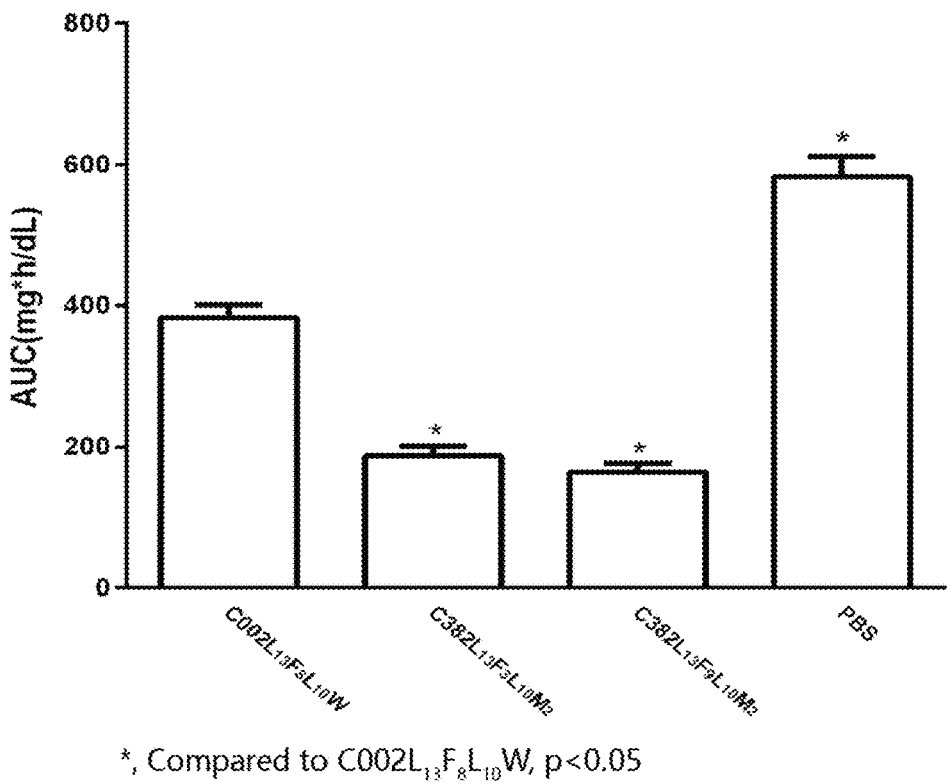
FIG. 9: the graph of the hypoglycemic effect of the active protein in Embodiment 11 on normal ICR mice.

The data in FIG. 9 shows that C382L13F3L10M2 and C382L13F9L10M2 have a significant hypoglycemic effect compared to C002L13F8L10W.

Embodiment 14

Figure 10:
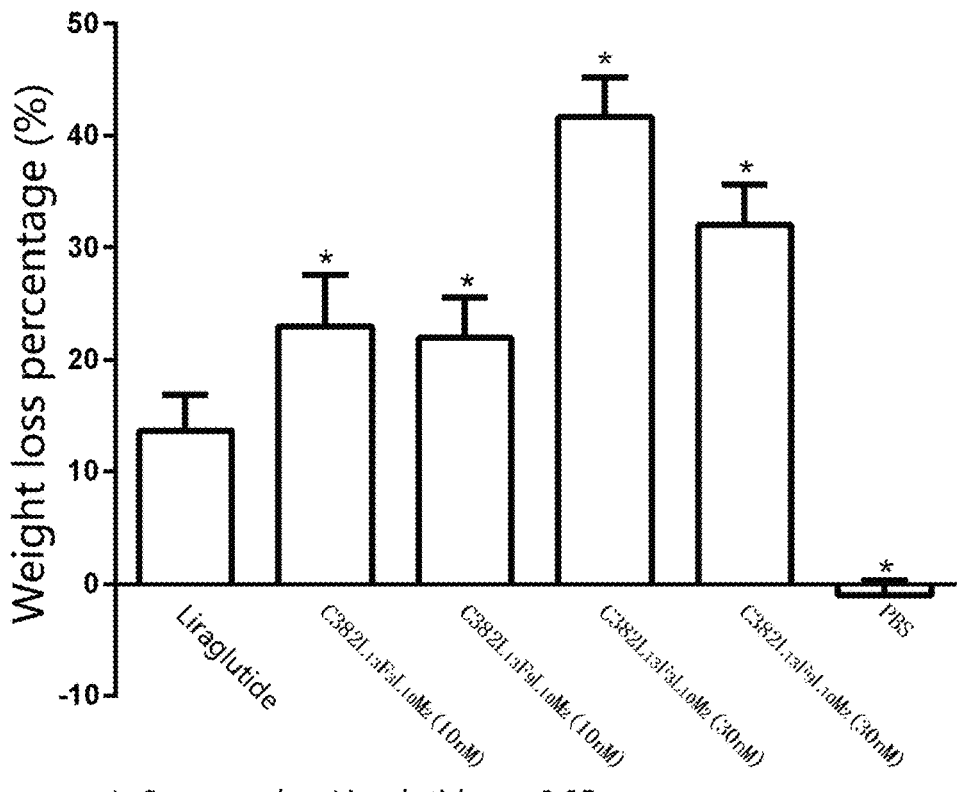
FIG. 10: the effect of the active protein in Embodiment 11 on the body weight of DIO mice.
Figure 11:
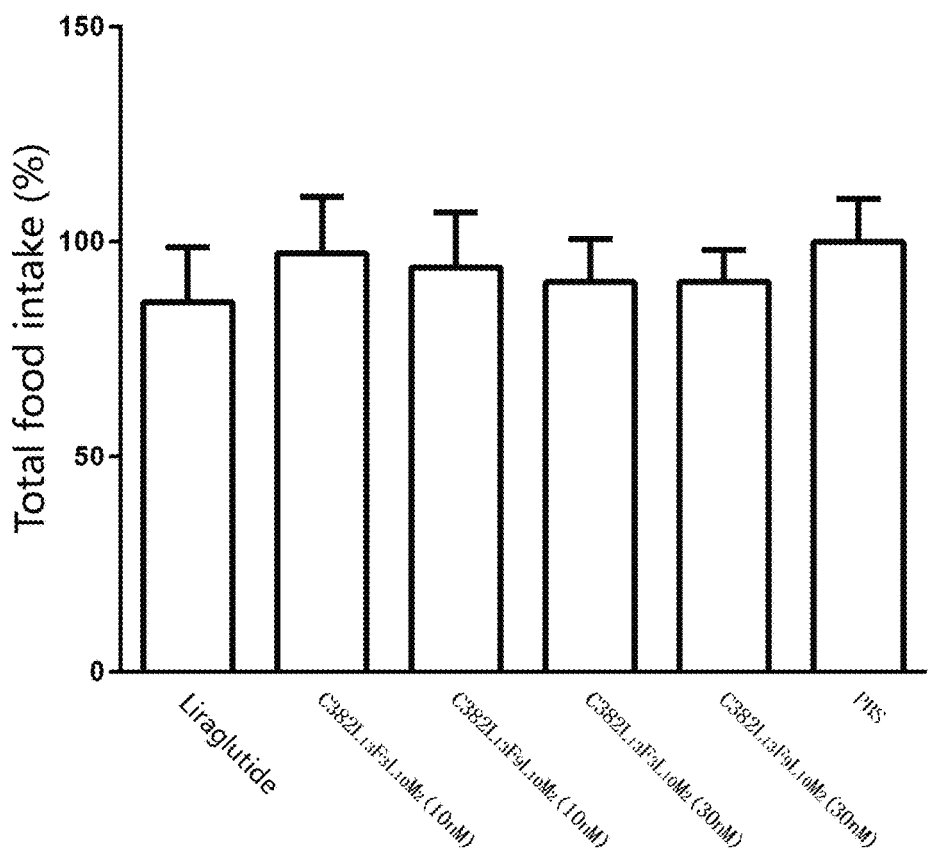
FIG. 11: the effect of the active protein in Embodiment 11 on the appetite of DIO mice; the food intake in DIO mice of PBS group is regarded as 100%, and the ordinate is the percentage of the food intake of mice in other groups compared with the DIO mice in the PBS group.

Pharmacodynamic Study of Continuous Administration of Tri-Agonist Active Proteins in Diet-Induced Obese (DIO) Mice The tri-agonist active proteins obtained in Embodiment 11 were continuously administered in the diet-induced obese (DIO) mice for pharmacodynamic study, following the same method illustrated in Embodiment 9. The results of weight changes are shown in FIG. 10. The change in total food intake is shown in FIG. 11.

FIG. 10 shows that the tri-agonist active proteins obtained in Embodiment 11 were significantly different from Liraglutide both at the doses of 10 nmol/kg and 30 nmol/kg. The weight loss was positively correlated with dose, and the weight loss effect at the dose of 30 nmol/kg was very obvious. FIG. 11 indicated that the tri-agonist active proteins obtained in Embodiment 11 have no significant effect on food intake at doses of 10 nmol/kg and 30 nmol/kg.

Embodiment 15

Random Blood Glucose Test after Continuous Administration of Tri-Agonist Active Proteins in db/db Mice Hypoglycemic study in leptin receptor-deficient Type 2 diabetes (db/db) mice. db/db mice were screened and evenly grouped according to body weights, non-fasting blood glucose, and OGTT response before drug administration. Each group consists of 10 mice. Individuals too large or too small were excluded as far as possible. Nonfasting blood glucose of animals selected should be greater than 15 mM. In addition, normal ICR mice were selected as basal blood glucose control. According to Table 8, the active proteins were injected subcutaneously at a dose of 20 nmol/kg of body weight. The administration is given once every 4 days, the first administration on day 0 and the last administration on day 24. Saline (PBS) (5 μl/g of body weight) was given to the negative control group; liraglutide (10 nmol/kg of body weight) was given to the positive control group. The above groups were administrated subcutaneously once a day for 26 consecutive days. Random blood glucose values were measured at 9 am before the first administration and day 2, 6, 10, 14, 18, 22, and 26. The results of random blood glucose changes are shown in FIG. 12.

Figure 12:
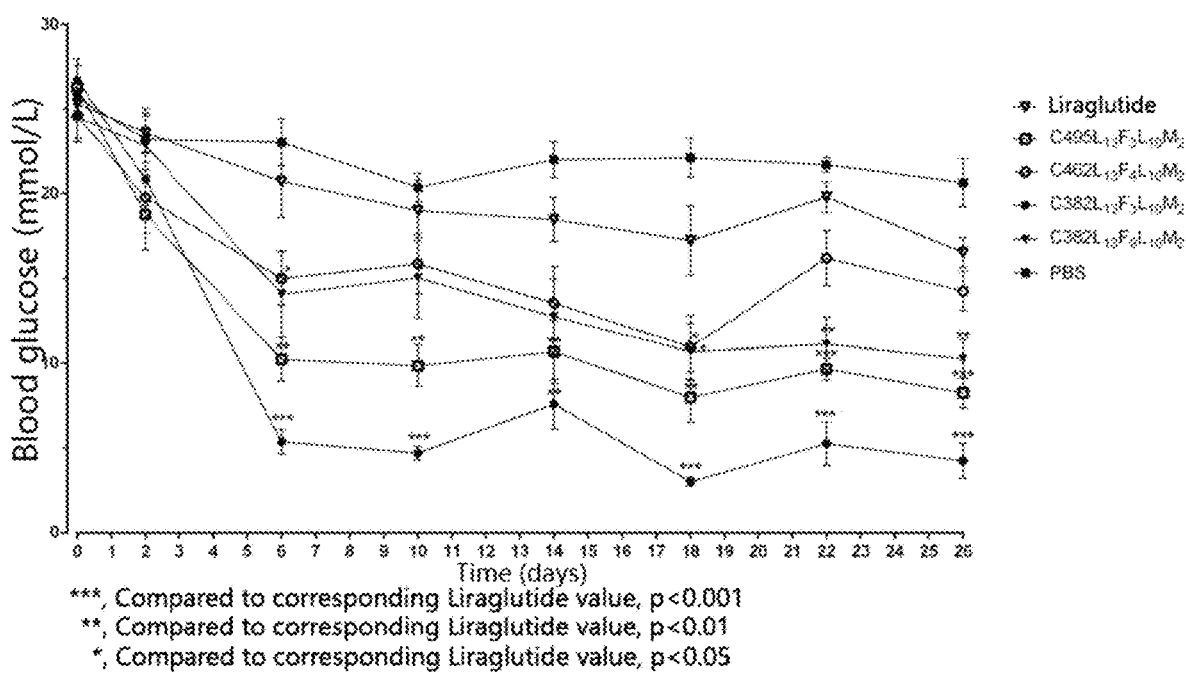
FIG. 12: the graph of the hypoglycemic effect of the tri-agonist active protein on the leptin receptor-deficient Type 2 diabetes (db/db) mice.

FIG. 12 shows that the hypoglycemic effect of the tri-agonist active proteins in Table 8 were significantly superior to the positive control, liraglutide, in the leptin receptor-deficient Type 2 diabetes (db/db) mice. The blood glucose level of $C382L_{13}F_3L_{10}M_2$ was comparable to the normal ICR mice control (not shown in the figure).

TABLE 8

| Samples | SEQ ID NO. | Dose (nM) |
|---|---|---|
| $C462L_{13}F_4L_{10}M_2$ | 179 | 20 |
| $C382L_{13}F_3L_{10}M_2$ | 336 | 20 |
| $C382L_{13}F_9L_{10}M_2$ | 338 | 20 |
| $C495L_{13}F_3L_{10}M_2$ | 340 | 20 |

Nucleotide sequences corresponding to the active proteins mentioned in this specification are shown in Table 9.

TABLE 9

| Serial number | Active protein | Corresponding nucleotide sequence |
|---|---|---|
| 1 | $C001L_{13}F_8$ | SEQ ID NO. 222 |
| 2 | $C002L_{13}F_8$ | SEQ ID NO. 223 |
| 3 | $CG283L_{13}F_8$ | SEQ ID NO. 224 |
| 4 | $C240L_{13}F_8$ | SEQ ID NO. 225 |
| 5 | $CG214L_{13}F_8$ | SEQ ID NO. 226 |
| 6 | $C382L_{13}F_8$ | SEQ ID NO. 227 |
| 7 | $CG267L_{13}F_8$ | SEQ ID NO. 228 |
| 8 | $C276L_{13}F_8$ | SEQ ID NO. 229 |
| 9 | $C308L_{13}F_8$ | SEQ ID NO. 230 |
| 10 | $C368L_{13}F_8$ | SEQ ID NO. 231 |
| 11 | $C224L_{13}F_8$ | SEQ ID NO. 232 |
| 12 | $C225L_{13}F_8$ | SEQ ID NO. 233 |
| 13 | $CG308L_{13}F_8$ | SEQ ID NO. 234 |
| 14 | $C495L_{13}F_8$ | SEQ ID NO. 235 |
| 15 | $C319L_{13}F_8$ | SEQ ID NO. 236 |
| 16 | $C364L_{13}F_8$ | SEQ ID NO. 237 |
| 17 | $C214L_{13}F_8$ | SEQ ID NO. 238 |
| 18 | $C232L_{13}F_8$ | SEQ ID NO. 239 |
| 19 | $C303L_{13}F_8$ | SEQ ID NO. 240 |
| 20 | $C392L_{13}F_8$ | SEQ ID NO. 241 |
| 21 | $CG303L_{13}F_8$ | SEQ ID NO. 242 |
| 22 | $C462L_{13}F_8$ | SEQ ID NO. 243 |
| 23 | $C240\ L_{12}F_8$ | SEQ ID NO. 244 |
| 24 | $C368\ L_{10}F_4$ | SEQ ID NO. 245 |
| 25 | $C364\ L_{10}F_4$ | SEQ ID NO. 246 |
| 26 | $C352\ L_{13}F_4$ | SEQ ID NO. 247 |
| 27 | $C225\ L_{10}F_{10}$ | SEQ ID NO. 248 |
| 28 | $C228L_{13}F_4$ | SEQ ID NO. 249 |
| 29 | $C187\ L_9F_4$ | SEQ ID NO. 250 |
| 30 | $C618\ L_{12}F_4$ | SEQ ID NO. 251 |
| 31 | $C623\ L_9F_3$ | SEQ ID NO. 252 |
| 32 | $C228\ L_{13}F_4$ | SEQ ID NO. 253 |
| 33 | $C498\ L_{13}F_4$ | SEQ ID NO. 254 |
| 34 | $C503\ L_{15}F_2$ | SEQ ID NO. 255 |
| 35 | $C508\ L_7F_4$ | SEQ ID NO. 256 |
| 36 | $C756\ L_{20}F_4$ | SEQ ID NO. 257 |
| 37 | $C788\ L_1F_5$ | SEQ ID NO. 258 |
| 38 | $C289\ L_{12}F_4$ | SEQ ID NO. 259 |
| 39 | $C611\ L_{11}F_4$ | SEQ ID NO. 260 |
| 40 | $C209\ L_{13}F_8$ | SEQ ID NO. 261 |
| 41 | $C627\ L_{12}F_{10}$ | SEQ ID NO. 262 |
| 42 | $C002L_{13}F_8L_{10}W$ | SEQ ID NO. 263 |
| 43 | $C240\ L_{12}F_8L_{12}M_1$ | SEQ ID NO. 264 |
| 44 | $C240\ L_9F_7L_{13}M_2$ | SEQ ID NO. 265 |
| 45 | $C240\ L_{13}F_4L_9M_1$ | SEQ ID NO. 266 |
| 46 | $C240\ L_9F_2L_{13}M_3$ | SEQ ID NO. 267 |
| 47 | $C240\ L_{13}F_{10}L_9M_2$ | SEQ ID NO. 268 |
| 48 | $C225\ L_{10}F_{10}L_{14}M_2$ | SEQ ID NO. 269 |
| 49 | $C163\ L_{13}F_8L_{13}M_2$ | SEQ ID NO. 270 |
| 50 | $C271\ L_9F_4L_8M_2$ | SEQ ID NO. 271 |
| 51 | $C368\ L_{10}F_4L_{40}M_2$ | SEQ ID NO. 272 |
| 52 | $C495\ L_{13}F_8L_{13}M_1$ | SEQ ID NO. 273 |
| 53 | $C495\ L_{13}F_8L_{10}M_2$ | SEQ ID NO. 274 |
| 54 | $C495\ L_9F_{10}L_9M_1$ | SEQ ID NO. 275 |
| 55 | $C353\ L_{13}F_3L_{10}M_4$ | SEQ ID NO. 276 |
| 56 | $C352\ L_{13}F_4L_9M_3$ | SEQ ID NO. 277 |
| 57 | $C382\ L_9F_3L_9M_2$ | SEQ ID NO. 278 |
| 58 | $C382\ L_{10}F_2L_{13}M_2$ | SEQ ID NO. 279 |
| 59 | $C382\ L_{13}F_{10}L_9M_1$ | SEQ ID NO. 280 |
| 60 | $C382\ L_{13}F_8L_{10}M_2$ | SEQ ID NO. 281 |
| 61 | $C382\ L_{12}F_7L_9M_2$ | SEQ ID NO. 282 |
| 62 | $C382\ L_{14}F_4L_9M_2$ | SEQ ID NO. 283 |
| 63 | $C232\ L_9F_3L_{10}M_3$ | SEQ ID NO. 284 |
| 64 | $C227\ L_{12}F_5L_{14}M_4$ | SEQ ID NO. 285 |
| 65 | $C266\ L_{13}F_7L_{13}M_4$ | SEQ ID NO. 286 |
| 66 | $C137\ L_{10}F_8L_9M_5$ | SEQ ID NO. 287 |
| 67 | $C399\ L_{12}F_4L_{19}M_8$ | SEQ ID NO. 288 |
| 68 | $C392\ L_{11}F_7L_{10}M_5$ | SEQ ID NO. 289 |
| 69 | $C462\ L_9F_2L_9M_{10}$ | SEQ ID NO. 290 |
| 70 | $C462\ L_{10}F_5L_{10}M_3$ | SEQ ID NO. 291 |
| 71 | $C462\ L_{11}F_8L_{13}M_1$ | SEQ ID NO. 292 |
| 72 | $C462\ L_{13}F_4L_{10}M_2$ | SEQ ID NO. 293 |
| 73 | $C462\ L_{13}F_8L_{10}M_2$ | SEQ ID NO. 294 |
| 74 | $C462\ L_{13}F_{10}L_9M_4$ | SEQ ID NO. 295 |
| 75 | $C228\ L_{13}F_4L_{13}M_{12}$ | SEQ ID NO. 296 |
| 76 | $C187\ L_9F_4L_{12}M_7$ | SEQ ID NO. 297 |
| 77 | $C364\ L_{10}F_4L_{12}M_8$ | SEQ ID NO. 298 |
| 78 | $C209\ L_{13}F_8L_{13}M_9$ | SEQ ID NO. 299 |
| 79 | $C289\ L_{12}F_4L_8M_{10}$ | SEQ ID NO. 300 |
| 80 | $C611\ L_{11}F_4L_{11}M_{11}$ | SEQ ID NO. 301 |
| 81 | $C618\ L_{13}F_7L_{13}M_1$ | SEQ ID NO. 302 |
| 82 | $C618\ L_{12}F_4L_{12}M_2$ | SEQ ID NO. 303 |
| 83 | $C623\ L_9F_3L_{10}M_1$ | SEQ ID NO. 304 |
| 84 | $C623\ L_9F_8L_9M_2$ | SEQ ID NO. 305 |
| 85 | $C627\ L_{12}F_{10}L_9M_6$ | SEQ ID NO. 306 |
| 86 | $C654\ L_{13}F_9L_6M_3$ | SEQ ID NO. 307 |
| 87 | $C673\ L_8F_3L_8M_8$ | SEQ ID NO. 308 |
| 88 | $C563\ L_{14}F_8L_9M_3$ | SEQ ID NO. 309 |
| 89 | $C549\ L_{12}F_4L_9M_4$ | SEQ ID NO. 310 |
| 90 | $C555\ L_{10}F_6L_{12}M_1$ | SEQ ID NO. 311 |

TABLE 9-continued

| Serial number | Active protein | Corresponding nucleotide sequence |
|---|---|---|
| 91 | C487 $L_{13}F_7L_{13}M_4$ | SEQ ID NO. 312 |
| 92 | C488 $L_9F_9L_9M_2$ | SEQ ID NO. 313 |
| 93 | C498 $L_{13}F_4L_{13}M_4$ | SEQ ID NO. 314 |
| 94 | C503 $L_{15}F_2L_9M_5$ | SEQ ID NO. 315 |
| 95 | C508 $L_7F_4L_9M_3$ | SEQ ID NO. 316 |
| 96 | C711 $L_{13}F_5L_{10}M_4$ | SEQ ID NO. 317 |
| 97 | C708 $L_{10}F_4L_{14}M_7$ | SEQ ID NO. 318 |
| 98 | C743 $L_{18}F_7L_8M_{10}$ | SEQ ID NO. 319 |
| 99 | C756 $L_{20}F_4L_{10}M_8$ | SEQ ID NO. 320 |
| 100 | C788 $L_1F_5L_5M_5$ | SEQ ID NO. 321 |
| 101 | C731 $L_5F_2L_9M_9$ | SEQ ID NO. 322 |
| 102 | $F_9L_{10}W$ | SEQ ID NO. 323 |
| 103 | $F_9L_{10}M_1$ | SEQ ID NO. 324 |
| 104 | $F_9L_{10}M_2$ | SEQ ID NO. 325 |
| 105 | $F_9L_{10}M_3$ | SEQ ID NO. 326 |
| 106 | $F_9L_{10}M_4$ | SEQ ID NO. 327 |
| 107 | $F_9L_{10}M_5$ | SEQ ID NO. 328 |
| 108 | $F_9L_{10}M_6$ | SEQ ID NO. 329 |
| 109 | $F_9L_{10}M_7$ | SEQ ID NO. 330 |
| 110 | $F_9L_{10}M_8$ | SEQ ID NO. 331 |
| 111 | $F_9L_{10}M_9$ | SEQ ID NO. 332 |
| 112 | $F_9L_{10}M_{10}$ | SEQ ID NO. 333 |
| 113 | $F_9L_{10}M_{11}$ | SEQ ID NO. 334 |
| 114 | $F_9L_{10}M_{12}$ | SEQ ID NO. 335 |
| 115 | $C382L_{13}F_3L_{10}M_2$ | SEQ ID NO. 336 |
| 116 | $C382L_{13}F_3L_{10}M_2$ | SEQ ID NO. 337 |
| 117 | $C382L_{13}F_9L_{10}M_2$ | SEQ ID NO. 338 |
| 118 | $C382L_{13}F_9L_{10}M_2$ | SEQ ID NO. 339 |
| 119 | $C495L_{13}F_3L_{10}M_2$ | SEQ ID NO. 340 |
| 120 | $C495L_{13}F_3L_{10}M_2$ | SEQ ID NO. 341 |

The above are only some preferred embodiments of the present disclosure instead of limitations on the present disclosure in any form or substance. It should be noted that, for those skilled in the art, improvements and supplements (including the fusion of the exemplary GCG analogues of the present disclosure with various $F_C$ and FGF21 analogue) may be made without departing from the methods of the present disclosure, the improvements and supplements shall also be covered by the protection of the present disclosure. The equivalent changes of alternations, modifications and evolutions can be made by those skilled in the art using the technical contents revealed above and without departing from the spirit and scope of the present disclosure, and those equivalent changes are regarded as equivalent embodiments of the present disclosure. Meanwhile, any alterations, modifications, and evolutions of any equivalent changes made to the above embodiments according to the essential technology of the present disclosure still fall within the scope of the technical solution of the present disclosure.

SEQUENCE LISTING (341 sequences)

SEQ ID NO: 1 - protein, 31 aa, Artificial Sequence
  The amino acid sequence of natural GLP-1
HAEGTFTSDVSSYLEGQAAKEFIAWLVKGRG

SEQ ID NO: 2 - protein, 37 aa, Artificial Sequence
  The amino acid sequence of natural Oxyntomodulin
HSQGTFTSDYSKYLDSRRAQDFVQWLMNTKRNRNNIA

SEQ ID NO: 3 - protein, 10 aa, Artificial Sequence
  Cex sequence
GPSSGAPPPS

SEQ ID NO: 4 - protein, 9 aa, Artificial Sequence
  Cex sequence
PSSGAPPPS

SEQ ID NO: 5 - protein, 8 aa, Artificial Sequence
  Cex sequence
SSGAPPPS

SEQ ID NO: 6 - protein, 9 aa, Artificial Sequence
  Cex sequence
GPSSGAPPS

SEQ ID NO: 7 - protein, 8 aa, Artificial Sequence
  Cex sequence
PSSGAPPS

SEQ ID NO: 8 - protein, 8 aa, Artificial Sequence
  Cex sequence
KRNRNNIA

SEQ ID NO: 9 - protein, 232 aa, Artificial Sequence
  The amino acid sequence of F
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 231 aa, Artificial Sequence
  The amino acid sequence of F
EPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 11 - protein, 227 aa, Artificial Sequence
  The amino acid sequence of F
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 226 aa, Artificial Sequence
  The amino acid sequence of F
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 13 - protein, 227 aa, Artificial Sequence
  The amino acid sequence of F
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 14 - protein, 229 aa, Artificial Sequence
  The amino acid sequence of F
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15 - protein, 229 aa, Artificial Sequence
  The amino acid sequence of F
ESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16 - protein, 228 aa, Artificial Sequence
  The amino acid sequence of F
ESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 17 - protein, 228 aa, Artificial Sequence
  The amino acid sequence of F
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 18 - protein, 228 aa, Artificial Sequence
  The amino acid sequence of F
ESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 19 - protein, 5 aa, Artificial Sequence
  The amino acid sequence of the connection chain
GGGGS

SEQ ID NO: 20 - protein, 5 aa, Artificial Sequence
  The amino acid sequence of the connection chain
GGGGA

SEQ ID NO: 21 - protein, 8 aa, Artificial Sequence
  The amino acid sequence of the connection chain
GGGSGGGS

SEQ ID NO: 22 - protein, 8 aa, Artificial Sequence
  The amino acid sequence of the connection chain
GSGSGSGS

SEQ ID NO: 23 - protein, 10 aa, Artificial Sequence
  The amino acid sequence of the connection chain
GGGGSGGGGS

SEQ ID NO: 24 - protein, 10 aa, Artificial Sequence
  The amino acid sequence of the connection chain
GGGGAGGGGA

SEQ ID NO: 25 - protein, 12 aa, Artificial Sequence
  The amino acid sequence of the connection chain
GGSGGGSGGGGS

SEQ ID NO: 26 - protein, 12 aa, Artificial Sequence
  The amino acid sequence of the connection chain
GGSGGGAGGGGS

SEQ ID NO: 27 - protein, 15 aa, Artificial Sequence
  The amino acid sequence of the connection chain
GGGGSGGGGSGGGGS

SEQ ID NO: 28 - protein, 15 aa, Artificial Sequence
  The amino acid sequence of the connection chain
GGGGAGGGGAGGGGA

SEQ ID NO: 29 - protein, 16 aa, Artificial Sequence
  The amino acid sequence of the connection chain
GGSGGGGSGGGGSGGA

SEQ ID NO: 30 - protein, 16 aa, Artificial Sequence
  The amino acid sequence of the connection chain
GGGGAGGGGAGGGGAA

SEQ ID NO: 31 - protein, 16 aa, Artificial Sequence
  The amino acid sequence of the connection chain
GGGGSGGGGSGGGGSA

SEQ ID NO: 32 - protein, 16 aa, Artificial Sequence
  The amino acid sequence of the connection chain
GGGGAGGGGAGGGGAA

SEQ ID NO: 33 - protein, 17 aa, Artificial Sequence
  The amino acid sequence of the connection chain
GSGGGGSGGGGSGGGGS

SEQ ID NO: 34 - protein, 20 aa, Artificial Sequence
  The amino acid sequence of the connection chain
GGGGAGGGGAGGGGAGGGGA

SEQ ID NO: 35 - protein, 20 aa, Artificial Sequence
  The amino acid sequence of the connection chain
GGGGSGGGGSGGGGSGGGGS

SEQ ID NO: 36 - protein, 22 aa, Artificial Sequence
  The amino acid sequence of the connection chain
GSGGGGSGGGGSGGGGSGGGGS

SEQ ID NO: 37 - protein, 25 aa, Artificial Sequence
  The amino acid sequence of the connection chain
GGGGSGGGGSGGGGSGGGGSGGGGS

SEQ ID NO: 38 - protein, 26 aa, Artificial Sequence
  The amino acid sequence of the connection chain
GGGGSGGGGSGGGGSGGGGSGGGGSA

SEQ ID NO: 39 - protein, 30 aa, Artificial Sequence
  The amino acid sequence of the connection chain
GGGGSGGGGSGGGGSGGGGSGGGGSGGGGS

SEQ ID NO: 40 - protein, 35 aa, Artificial Sequence
  The amino acid sequence of the connection chain
GGGGSGGGGSGGGGSGGGGSGGGGSGGGGSGGGGS

SEQ ID NO: 41 - protein, 40 aa, Artificial Sequence
  The amino acid sequence of the connection chain
GGGGSGGGGSGGGGSGGGGSGGGGSGGGGSGGGGSGGGGS

SEQ ID NO: 42 - protein, 29 aa, Artificial Sequence
  The amino acid sequence of natural glucagon
HSQGTFTSDYSKYLDSRRAQDFVQWLMNT

SEQ ID NO: 43 - protein, 39 aa, Artificial Sequence
  The amino acid sequence of the GCG analogue
HSQGTFTSDYSKYLDSRRAQDFVQWLMNTGPSSGAPPPS

SEQ ID NO: 44 - protein, 39 aa, Artificial Sequence
  The amino acid sequence of the GCG analogue
HSQGTFTSDYSKYLDERAAQDFVQWLMNGGPSSGAPPPS

SEQ ID NO: 45 - protein, 39 aa, Artificial Sequence
  The amino acid sequence of the GCG analogue
HSQGTFTSDYSKYLDEREAQDFVQWLMNGGPSSGAPPPS

SEQ ID NO: 46 - protein, 39 aa, Artificial Sequence
  The amino acid sequence of the GCG analogue
HSQGTFTSDYSKYLDSRAAQDFVQWLMNGGPSSGAPPPS

SEQ ID NO: 47 - protein, 39 aa, Artificial Sequence
  The amino acid sequence of the GCG analogue
HSQGTFTSDYSKYLDERAAQDFVQWLMNTGPSSGAPPPS

SEQ ID NO: 48 - protein, 39 aa, Artificial Sequence
  The amino acid sequence of the GCG analogue
HSQGTFTSDYSKYLDSREAQDFVQWLMNGGPSSGAPPPS

SEQ ID NO: 49 - protein, 39 aa, Artificial Sequence
  The amino acid sequence of the GCG analogue
HSQGTFTSDYSKYLDSRAAQDFVQWLMNTGPSSGAPPPS

SEQ ID NO: 50 - protein, 39 aa, Artificial Sequence
  The amino acid sequence of the GCG analogue
HSQGTFTSDYSKYLDSQEAQDFVQWLMNGGPSSGAPPPS

SEQ ID NO: 51 - protein, 39 aa, Artificial Sequence
  The amino acid sequence of the GCG analogue
HSQGTFTSDYSKYLDGRAAQDFVQWLMNTGPSSGAPPPS

SEQ ID NO: 52 - protein, 39 aa, Artificial Sequence
  The amino acid sequence of the GCG analogue
HSQGTFTSDYSKYLDEQAAQDFVQWLMNTGPSSGAPPPS

SEQ ID NO: 53 - protein, 39 aa, Artificial Sequence
  The amino acid sequence of the GCG analogue
HSQGTFTSDYSKYLDEQAAQDFVQWLMNGGPSSGAPPPS

SEQ ID NO: 54 - protein, 37 aa, Artificial Sequence
  The amino acid sequence of the GCG analogue
HSQGTFTSDYSKYLDEQAAQDFVQWLMNGPSSGAPPS

SEQ ID NO: 55 - protein, 38 aa, Artificial Sequence
  The amino acid sequence of the GCG analogue
HSQGTFTSDYSKYLDEQAAQDFVQWLMNGPSSGAPPPS

SEQ ID NO: 56 - protein, 38 aa, Artificial Sequence
  The amino acid sequence of the GCG analogue
HSQGTFTSDYSKYLDEQEAQDFVQWLMNGPSSGAPPPS

SEQ ID NO: 57 - protein, 39 aa, Artificial Sequence
  The amino acid sequence of the GCG analogue
HSQGTFTSDYSKYLDSQAAQDFVQWLMNGGPSSGAPPPS

SEQ ID NO: 58 - protein, 39 aa, Artificial Sequence
  The amino acid sequence of the GCG analogue
HSQGTFTSDYSKYLDSQAAQDFVQWLMNTGPSSGAPPPS

SEQ ID NO: 59 - protein, 38 aa, Artificial Sequence
  The amino acid sequence of the GCG analogue
HSQGTFTSDYSKYLDSQAAQDFVQWLMNTGPSSGAPPS

SEQ ID NO: 60 - protein, 38 aa, Artificial Sequence
  The amino acid sequence of the GCG analogue
HSQGTFTSDYSKYLDSQAAQDFVQWLMNGPSSGAPPPS

SEQ ID NO: 61 - protein, 39 aa, Artificial Sequence
  The amino acid sequence of the GCG analogue
HSQGTFTSDYSKYLDSERAQDFVQWLMNTGPSSGAPPPS

SEQ ID NO: 62 - protein, 39 aa, Artificial Sequence
  The amino acid sequence of the GCG analogue
HSQGTFTSDYSKYLDGERAQDFVQWLMNTGPSSGAPPPS

SEQ ID NO: 63 - protein, 39 aa, Artificial Sequence
  The amino acid sequence of the GCG analogue
HSQGTFTSDYSKYLDGEEAQDFVQWLMNTGPSSGAPPPS

SEQ ID NO: 64 - protein, 39 aa, Artificial Sequence
  The amino acid sequence of the GCG analogue
HSQGTFTSDYSKYLDGREAQDFVQWLMNGGPSSGAPPPS

SEQ ID NO: 65 - protein, 39 aa, Artificial Sequence
  The amino acid sequence of the GCG analogue
HSQGTFTSDYSKYLDEEAAQDFVQWLMNTGPSSGAPPPS

SEQ ID NO: 66 - protein, 39 aa, Artificial Sequence
  The amino acid sequence of the GCG analogue
HSQGTFTSDYSKYLDEEAAQDFVQWLMNGGPSSGAPPPS

SEQ ID NO: 67 - protein, 39 aa, Artificial Sequence
  The amino acid sequence of the GCG analogue
HSQGTFTSDYSKYLDEERAQDFVQWLMNTGPSSGAPPPS

SEQ ID NO: 68 - protein, 39 aa, Artificial Sequence
  The amino acid sequence of the GCG analogue
HSQGTFTSDYSKYLDSQRAQDFVQWLMNTGPSSGAPPPS

SEQ ID NO: 69 - protein, 39 aa, Artificial Sequence
  The amino acid sequence of the GCG analogue
HSQGTFTSDYSKYLDGQEAQDFVQWLMNGGPSSGAPPPS

SEQ ID NO: 70 - protein, 39 aa, Artificial Sequence
  The amino acid sequence of the GCG analogue
HSQGTFTSDYSKYLDGQAAQDFVQWLMNGGPSSGAPPPS

SEQ ID NO: 71 - protein, 39 aa, Artificial Sequence
  The amino acid sequence of the GCG analogue
HSQGTFTSDYSKYLDSEAAQDFVQWLMNGGPSSGAPPPS

SEQ ID NO: 72 - protein, 39 aa, Artificial Sequence
  The amino acid sequence of the GCG analogue
HSQGTFTSDYSKYLDGEAAQDFVQWLMNGGPSSGAPPPS

SEQ ID NO: 73 - protein, 38 aa, Artificial Sequence
  The amino acid sequence of the GCG analogue
HSQGTFTSDYSKYLDERAAQDFVQWLLDGPSSGAPPPS

SEQ ID NO: 74 - protein, 39 aa, Artificial Sequence
  The amino acid sequence of the GCG analogue
HSQGTFTSDLSKQMDSRAAQDFIEWLKNGGPSSGAPPPS

SEQ ID NO: 75 - protein, 39 aa, Artificial Sequence
  The amino acid sequence of the GCG analogue
HSQGTFTSDLSKQMDSREAQDFIEWLKNTGPSSGAPPPS

SEQ ID NO: 76 - protein, 39 aa, Artificial Sequence
  The amino acid sequence of the GCG analogue
HSQGTFTSDYSKQMDSQRAQDFVQWLMNGGPSSGAPPPS

SEQ ID NO: 77 - protein, 39 aa, Artificial Sequence
  The amino acid sequence of the GCG analogue
HSQGTFTSDYSKQLDSQRAQDFVQWLMNGGPSSGAPPPS

SEQ ID NO: 78 - protein, 39 aa, Artificial Sequence
  The amino acid sequence of the GCG analogue
HSQGTFTSDYSKYLDEEAAQDFIEWLKNTGPSSGAPPPS

SEQ ID NO: 79 - protein, 39 aa, Artificial Sequence
  The amino acid sequence of the GCG analogue
HSQGTFTSDYSSYLDEEAAQDFIEWLKNTGPSSGAPPPS

SEQ ID NO: 80 - protein, 38 aa, Artificial Sequence
  The amino acid sequence of the GCG analogue
HSQGTFTSDVSKYLESRAAQDFVQWMNGGPSSGAPPPS

SEQ ID NO: 81 - protein, 38 aa, Artificial Sequence
  The amino acid sequence of the GCG analogue
HSQGTFTSDLSKYLEEQAAQDFVQWMNGGPSSGAPPPS

SEQ ID NO: 82 - protein, 38 aa, Artificial Sequence
  The amino acid sequence of the GCG analogue
HSQGTFTSDLSKYLEGQAAQDFVQWMNGGPSSGAPPPS

SEQ ID NO: 83 - protein, 38 aa, Artificial Sequence
  The amino acid sequence of the GCG analogue
HSQGTFTSDLSKYLEGQAAQDFVQWMNTGPSSGAPPPS

SEQ ID NO: 84 - protein, 30 aa, Artificial Sequence
  The amino acid sequence of the GCG analogue
HSQGTFTSDYSEYLDSERARDFVAWLEAGG

SEQ ID NO: 85 - protein, 29 aa, Artificial Sequence
  The amino acid sequence of the GCG analogue
HSQGTFTSDYSKYLEEEAVRLFIQWLMNT

SEQ ID NO: 86 - protein, 39 aa, Artificial Sequence
  The amino acid sequence of the GCG analogue
HSQGTFTSDYSKYLEEEAVRLFIQWLMNGGPSSGAPPPS

SEQ ID NO: 87 - protein, 37 aa, Artificial Sequence
  The amino acid sequence of the GCG analogue
HSQGTFTSDYSKYLDSQAAQDFVQWLMNTKRNRNNIA

SEQ ID NO: 88 - protein, 37 aa, Artificial Sequence
  The amino acid sequence of the GCG analogue
HSQGTFTSDYSKYLDSEAAQDFVQWLMNTKRNRNNIA

SEQ ID NO: 89 - protein, 37 aa, Artificial Sequence
  The amino acid sequence of the GCG analogue
HSQGTFTSDYSKYLDSQEAQDFVQWLMNTKRNRNNIA

SEQ ID NO: 90 - protein, 37 aa, Artificial Sequence
  The amino acid sequence of the GCG analogue
HSQGTFTSDYSKYLDEQAAQDFVQWLMNTKRNRNNIA

SEQ ID NO: 91 - protein, 37 aa, Artificial Sequence
  The amino acid sequence of the GCG analogue
HSQGTFTSDYSKQMDSQRAQDFVQWLMNTKRNRNNIA

SEQ ID NO: 92 - protein, 37 aa, Artificial Sequence
  The amino acid sequence of the GCG analogue
HSQGTFTSDLSKQMDSRAAQDFIEWLKNTKRNRNNIA

SEQ ID NO: 93 - protein, 273 aa, Artificial Sequence
  The amino acid sequence of C001L13F8
HSQGTFTSDYSKYLDSRRAQDFVQWLMNTGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 94 - protein, 283 aa, Artificial Sequence
  The amino acid sequence of C002L13F8
HSQGTFTSDYSKYLDSRRAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 95 - protein, 273 aa, Artificial Sequence
  The amino acid sequence of CG283L13F8
HSQGTFTSDYSKYLDERAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 96 - protein, 283 aa, Artificial Sequence
  The amino acid sequence of C240L13F8
HSQGTFTSDYSKYLDERAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 97 - protein, 273 aa, Artificial Sequence
  The amino acid sequence of CG214L13F8
HSQGTFTSDYSKYLDSQAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 98 - protein, 283 aa, Artificial Sequence
  The amino acid sequence of C382L13F8
HSQGTFTSDYSKYLDSQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 99 - protein, 273 aa, Artificial Sequence
  The amino acid sequence of CG267L13F8
HSQGTFTSDYSKYLDSRAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 100 - protein, 283 aa, Artificial Sequence
  The amino acid sequence of C276L13F8
HSQGTFTSDYSKYLDSRAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 101 - protein, 273 aa, Artificial Sequence
  The amino acid sequence of C308L13F8
HSQGTFTSDYSKYLDEQAAQDFVQWLMNTGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 102 - protein, 283 aa, Artificial Sequence
  The amino acid sequence of C368L13F8
HSQGTFTSDYSKYLDEQAAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 103 - protein, 273 aa, Artificial Sequence
  The amino acid sequence of C224L13F8
HSQGTFTSDYSKYLDERAAQDFVQWLMNTGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 104 - protein, 283 aa, Artificial Sequence
  The amino acid sequence of C225L13F8
HSQGTFTSDYSKYLDERAAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 105 - protein, 273 aa, Artificial Sequence
  The amino acid sequence of CG308L13F8
HSQGTFTSDYSKYLDEQAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 106 - protein, 283 aa, Artificial Sequence
  The amino acid sequence of C495L13F8
HSQGTFTSDYSKYLDEQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 107 - protein, 273 aa, Artificial Sequence
  The amino acid sequence of C319L13F8
HSQGTFTSDYSKYLDGQAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 108 - protein, 283 aa, Artificial Sequence
  The amino acid sequence of C364L13F8
HSQGTFTSDYSKYLDGQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 109 - protein, 273 aa, Artificial Sequence
  The amino acid sequence of C214L13F8
HSQGTFTSDYSKYLDSQAAQDFVQWLMNTGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 110 - protein, 283 aa, Artificial Sequence
  The amino acid sequence of C232L13F8
HSQGTFTSDYSKYLDSQAAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 111 - protein, 273 aa, Artificial Sequence
  The amino acid sequence of C303L13F8
HSQGTFTSDYSKYLDEEAAQDFVQWLMNTGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 112 - protein, 283 aa, Artificial Sequence
  The amino acid sequence of C392L13F8
HSQGTFTSDYSKYLDEEAAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 113 - protein, 273 aa, Artificial Sequence
  The amino acid sequence of CG303L13F8
HSQGTFTSDYSKYLDEEAAQDFVQWLMNGGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 114 - protein, 283 aa, Artificial Sequence
  The amino acid sequence of C462L13F8
HSQGTFTSDYSKYLDEEAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 115 - protein, 283 aa, Artificial Sequence
  The amino acid sequence of C240L12F8
HSQGTFTSDYSKYLDERAAQDFVQWLMNGGPSSGAPPPSGGGGAGGGGAGGGGAAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 116 - protein, 280 aa, Artificial Sequence
  The amino acid sequence of C368L10F4
HSQGTFTSDYSKYLDEQAAQDFVQWLMNTGPSSGAPPPSGGGGAGGGGAGGGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 117 - protein, 280 aa, Artificial Sequence
  The amino acid sequence of C364L10F4
HSQGTFTSDYSKYLDGQAAQDFVQWLMNGGPSSGAPPPSGGGGAGGGGAGGGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 118 - protein, 280 aa, Artificial Sequence
  The amino acid sequence of C352L13F4
HSQGTFTSDYSKYLDEQAAQDFVQWLMNGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 119 - protein, 282 aa, Artificial Sequence
  The amino acid sequence of C225L10F10
HSQGTFTSDYSKYLDERAAQDFVQWLMNTGPSSGAPPPSGGGGAGGGGAGGGGAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 120 - protein, 281 aa, Artificial Sequence
  The amino acid sequence of C228L13F4
HSQGTFTSDYSKYLDEERAQDFVQWLMNTGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 121 - protein, 280 aa, Artificial Sequence
  The amino acid sequence of C187L9F4
HSQGTFTSDYSKYLDSQRAQDFVQWLMNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 122 - protein, 281 aa, Artificial Sequence
  The amino acid sequence of C618L12F4
HSQGTFTSDLSKQMDSRAAQDFIEWLKNGGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 123 - protein, 281 aa, Artificial Sequence
  The amino acid sequence of C623L9F3
HSQGTFTSDLSKQMDSREAQDFIEWLKNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 281 aa, Artificial Sequence; identical to SEQ ID NO: 120
  The amino acid sequence of C228L13F4

SEQ ID NO: 125 - protein, 272 aa, Artificial Sequence
  The amino acid sequence of C498L13F4
HSQGTFTSDYSEYLDSERARDFVAWLEAGGGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 126 - protein, 277 aa, Artificial Sequence
  The amino acid sequence of C503L15F2
HSQGTFTSDYSKYLEEEAVRLFIQWLMNTGSGGGGSGGGGSGGGGSEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 127 - protein, 277 aa, Artificial Sequence
  The amino acid sequence of C508L7F4
HSQGTFTSDYSKYLEEEAVRLFIQWLMNGGPSSGAPPPSGGSGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 128 - protein, 289 aa, Artificial Sequence
  The amino acid sequence of C756L20F4
HSQGTFTSDYSKYLDEQAAQDFVQWLMNTKRNRNNIAGGGGSGGGGSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 129 - protein, 269 aa, Artificial Sequence
  The amino acid sequence of C788L1F5
HSQGTFTSDYSKQMDSQRAQDFVQWLMNTKRNRNNIAGGGGSERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 130 - protein, 281 aa, Artificial Sequence
  The amino acid sequence of C289L12F4
HSQGTFTSDYSKYLDGEAAQDFVQWLMNGGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 131 - protein, 280 aa, Artificial Sequence
  The amino acid sequence of C611L11F4
HSQGTFTSDYSKYLDERAAQDFVQWLLDGPSSGAPPPSGGSGGGGSGGGGSGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 132 - protein, 283 aa, Artificial Sequence
  The amino acid sequence of C209L13F8
HSQGTFTSDYSKYLDSEAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 133 - protein, 283 aa, Artificial Sequence
  The amino acid sequence of C627L12F10
HSQGTFTSDYSKQMDSQRAQDFVQWLMNGGPSSGAPPPSGGGGAGGGGAGGGGAAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 134 - protein, 40 aa, Artificial Sequence
  The amini acid sequence of GDSerGS
HDSQGTFTSDYSKYLDSQAAQDFVQWLMNGGPSSGAPPPS

SEQ ID NO: 135 - protein, 39 aa, Artificial Sequence
  The amini acid sequence of GAibGS
  misc_feature (2)..(2): Xaa can be any naturally occurring amino acid
HXQGTFTSDYSKYLDSQAAQDFVQWLMNGGPSSGAPPPS

SEQ ID NO: 136 - protein, 181 aa, Artificial Sequence
  The amino acid sequence of natural FGF21
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 137 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 138 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 139 - protein, 177 aa, Artificial Sequence
  The amino acid sequence of FGF21 analogue
DSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 140 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 141 - protein, 181 aa, Artificial Sequence
  The amino acid sequence of FGF21 analogue
HPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 142 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVEPSQGRSPSYAS

SEQ ID NO: 143 - protein, 181 aa, Artificial Sequence
  The amino acid sequence of FGF21 analogue
HPIPDSSPLLQFGGQVRQEYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 144 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 145 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 146 - protein, 177 aa, Artificial Sequence
  The amino acid sequence of FGF21 analogue
DSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 147 - protein, 181 aa, Artificial Sequence
  The amino acid sequence of FGF21 analogue
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLAMVGGSQGRSPSYES

SEQ ID NO: 148 - protein, 181 aa, Artificial Sequence; identical to SEQ ID NO: 145
  The amino acid sequence of FGF21 analogue

SEQ ID NO: 149 - protein, 477 aa, Artificial Sequence
  The amino acid sequence of C002L13F8L10W
HSQGTFTSDYSKYLDSRRAQDFVQWLMNTGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 150 - protein, 480 aa, Artificial Sequence
  The amino acid sequence of C240 L12F8L12M1
HSQGTFTSDYSKYLDERAAQDFVQWLMNGGPSSGAPPPSGGGGAGGGGAGGGGAAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 151 - protein, 480 aa, Artificial Sequence
  The amino acid sequence of C240 L9F7L13M2
HSQGTFTSDYSKYLDERAAQDFVQWLMNGGPSSGAPPPSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 152 - protein, 477 aa, Artificial Sequence
  The amino acid sequence of C240 L13F4L9M1
HSQGTFTSDYSKYLDERAAQDFVQWLMNGGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 153 - protein, 478 aa, Artificial Sequence
  The amino acid sequence of C240 L9F2L13M3
HSQGTFTSDYSKYLDERAAQDFVQWLMNGGPSSGAPPPSGGGGSGGGGSGGGGSEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSADSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 154 - protein, 479 aa, Artificial Sequence
  The amino acid sequence of C240 L13F10L9M2
HSQGTFTSDYSKYLDERAAQDFVQWLMNGGPSSGAPPPSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 155 - protein, 479 aa, Artificial Sequence
  The amino acid sequence of C225 L10F10L14M2
HSQGTFTSDYSKYLDERAAQDFVQWLMNTGPSSGAPPPSGGGGAGGGGAGGGGAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGASHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 156 - protein, 480 aa, Artificial Sequence
  The amino acid sequence of C163 L13F8L13M2
HSQGTFTSDYSKYLDSRAAQDFVQWLMNTGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 157 - protein, 473 aa, Artificial Sequence
  The amino acid sequence of C271 L9F4L8M2
HSQGTFTSDYSKYLDGRAAQDFVQWLMNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGGAGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 158 - protein, 476 aa, Artificial Sequence
  The amino acid sequence of C368 L10F4L10M2
HSQGTFTSDYSKYLDEQAAQDFVQWLMNTGPSSGAPPPSGGGGAGGGGAGGGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 159 - protein, 480 aa, Artificial Sequence
  The amino acid sequence of C495 L13F8L13M1
HSQGTFTSDYSKYLDEQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 160 - protein, 479 aa, Artificial Sequence
  The amino acid sequence of C495 L13F8L10M2
HSQGTFTSDYSKYLDEQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 161 - protein, 478 aa, Artificial Sequence
  The amino acid sequence of C495 L9F10L9M1
HSQGTFTSDYSKYLDEQAAQDFVQWLMNGGPSSGAPPPSGGGGSGGGGSGGGGSESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 162 - protein, 476 aa, Artificial Sequence
  The amino acid sequence of C353 L13F3L10M4
HSQGTFTSDYSKYLDEQAAQDFVQWLMNGPSSGAPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 163 - protein, 472 aa, Artificial Sequence
  The amino acid sequence of C352 L13F4L9M3
HSQGTFTSDYSKYLDEQAAQDFVQWLMNGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 164 - protein, 477 aa, Artificial Sequence
  The amino acid sequence of C382 L9F3L9M2
HSQGTFTSDYSKYLDSQAAQDFVQWLMNGGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 165 - protein, 482 aa, Artificial Sequence
  The amino acid sequence of C382 L10F2L13M2
HSQGTFTSDYSKYLDSQAAQDFVQWLMNGGPSSGAPPPSGGGGAGGGGAGGGGAEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 166 - protein, 479 aa, Artificial Sequence
  The amino acid sequence of C382 L13F10L9M1
HSQGTFTSDYSKYLDSQAAQDFVQWLMNGGPSSGAPPPSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 167 - protein, 479 aa, Artificial Sequence
  The amino acid sequence of C382 L13F8L10M2
HSQGTFTSDYSKYLDSQAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 168 - protein, 480 aa, Artificial Sequence
  The amino acid sequence of C382 L12F7L9M2
HSQGTFTSDYSKYLDSQAAQDFVQWLMNGGPSSGAPPPSGGGGAGGGGAGGGGAAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 169 - protein, 477 aa, Artificial Sequence
  The amino acid sequence of C382 L14F4L9M2
HSQGTFTSDYSKYLDSQAAQDFVQWLMNGGPSSGAPPPSGGGGAGGGGAGGGGASDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 170 - protein, 473 aa, Artificial Sequence
  The amino acid sequence of C232 L9F3L10M3
HSQGTFTSDYSKYLDSQAAQDFVQWLMNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAGGGGAGGGGADSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 171 - protein, 478 aa, Artificial Sequence
  The amino acid sequence of C227 L12F5L14M4
HSQGTFTSDYSKYLDSQAAQDFVQWLMNTGPSSGAPPSGGGGAGGGGAGGGGAAERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGGGGAGGGGASHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 172 - protein, 480 aa, Artificial Sequence
  The amino acid sequence of C266 L13F7L13M4
HSQGTFTSDYSKYLDSQAAQDFVQWLMNGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 173 - protein, 478 aa, Artificial Sequence
  The amino acid sequence of C137 L10F8L9M5
HSQGTFTSDYSKYLDSERAQDFVQWLMNTGPSSGAPPPSGGGGAGGGGAGGGGAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 174 - protein, 487 aa, Artificial Sequence
  The amino acid sequence of C399 L12F4L19M8
HSQGTFTSDYSKYLDGERAQDFVQWLMNTGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 175 - protein, 480 aa, Artificial Sequence
  The amino acid sequence of C392 L11F7L10M5
HSQGTFTSDYSKYLDEEAAQDFVQWLMNTGPSSGAPPPSGGSGGGGSGGGGSGGAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGAGGGGAGGGGAHPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 176 - protein, 477 aa, Artificial Sequence
  The amino acid sequence of C462 L9F2L9M10
HSQGTFTSDYSKYLDEEAAQDFVQWLMNGGPSSGAPPPSGGGGSGGGGSGGGGSEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 177 - protein, 473 aa, Artificial Sequence
  The amino acid sequence of C462 L10F5L10M3
HSQGTFTSDYSKYLDEEAAQDFVQWLMNGGPSSGAPPPSGGGGAGGGGAGGGGAERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGGGGAGGGGADSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 178 - protein, 480 aa, Artificial Sequence
  The amino acid sequence of C462 L11F8L13M1
HSQGTFTSDYSKYLDEEAAQDFVQWLMNGGPSSGAPPPSGGSGGGGSGGGGSGGAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 179 - protein, 477 aa, Artificial Sequence
  The amino acid sequence of C462 L13F4L10M2
HSQGTFTSDYSKYLDEEAAQDFVQWLMNGGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 180 - protein, 479 aa, Artificial Sequence
  The amino acid sequence of C462 L13F8L10M2
HSQGTFTSDYSKYLDEEAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 181 - protein, 479 aa, Artificial Sequence
  The amino acid sequence of C462 L13F10L9M4
HSQGTFTSDYSKYLDEEAAQDFVQWLMNGGPSSGAPPPSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 182 - protein, 478 aa, Artificial Sequence
  The amino acid sequence of C228 L13F4L13M12
HSQGTFTSDYSKYLDEERAQDFVQWLMNTGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 183 - protein, 477 aa, Artificial Sequence
  The amino acid sequence of C187 L9F4L12M7
HSQGTFTSDYSKYLDSQRAQDFVQWLMNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAAHPIPDSSPLLQFGGQVRQEYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 184 - protein, 477 aa, Artificial Sequence
  The amino acid sequence of C364 L10F4L12M8
HSQGTFTSDYSKYLDGQAAQDFVQWLMNGGPSSGAPPPSGGGGAGGGGAGGGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 185 - protein, 480 aa, Artificial Sequence
  The amino acid sequence of C209 L13F8L13M9
HSQGTFTSDYSKYLDSEAAQDFVQWLMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 186 - protein, 470 aa, Artificial Sequence
  The amino acid sequence of C289 L12F4L8M10
HSQGTFTSDYSKYLDGEAAQDFVQWLMNGGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGGAGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 187 - protein, 477 aa, Artificial Sequence
  The amino acid sequence of C611 L11F4L11M11
HSQGTFTSDYSKYLDERAAQDFVQWLLDGPSSGAPPPSGGSGGGGSGGGGSGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGGGSGGGGSGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLAMVGGSQGRSPSYES

SEQ ID NO: 188 - protein, 481 aa, Artificial Sequence
  The amino acid sequence of C618 L13F7L13M1
HSQGTFTSDLSKQMDSRAAQDFIEWLKNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 189 - protein, 478 aa, Artificial Sequence
  The amino acid sequence of C618 L12F4L12M2
HSQGTFTSDLSKQMDSRAAQDFIEWLKNGGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 190 - protein, 477 aa, Artificial Sequence
  The amino acid sequence of C623 L9F3L10M1
HSQGTFTSDLSKQMDSREAQDFIEWLKNTGPSSGAPPPSGGGGSGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 191 - protein, 478 aa, Artificial Sequence
  The amino acid sequence of C623 L9F8L9M2
HSQGTFTSDLSKQMDSREAQDFIEWLKNTGPSSGAPPPSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 192 - protein, 479 aa, Artificial Sequence
  The amino acid sequence of C627 L12F10L9M6
HSQGTFTSDYSKQMDSQRAQDFVQWLMNGGPSSGAPPPSGGGGAGGGGAGGGGAAESKYGPPCPPCPAPEAAGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVEPSQGRSPSYAS

SEQ ID NO: 193 - protein, 470 aa, Artificial Sequence
  The amino acid sequence of C654 L13F9L6M3
HSQGTFTSDYSKQLDSQRAQDFVQWLMNGGPSSGAPPPSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGADSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 194 - protein, 471 aa, Artificial Sequence
  The amino acid sequence of C673 L8F3L8M8
HSQGTFTSDYSKYLDEEAAQDFIEWLKNTGPSSGAPPPSGGSGGGAGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGGAGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 195 - protein, 475 aa, Artificial Sequence
  The amino acid sequence of C563 L14F8L9M3
HSQGTFTSDYSSYLDEEAAQDFIEWLKNTGPSSGAPPPSGGGGAGGGGAGGGGASESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 196 - protein, 476 aa, Artificial Sequence
  The amino acid sequence of C549 L12F4L9M4
HSQGTFTSDVSKYLESRAAQDFVQWMNGGPSSGAPPPSGGGGAGGGGAGGGGAADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 197 - protein, 479 aa, Artificial Sequence
  The amino acid sequence of C555 L10F6L12M1
HSQGTFTSDLSKYLEEQAAQDFVQWMNGGPSSGAPPPSGGGGAGGGGAGGGGAESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGAGGGGAGGGGAAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 198 - protein, 480 aa, Artificial Sequence
  The amino acid sequence of C487 L13F7L13M4
HSQGTFTSDLSKYLEGQAAQDFVQWMNGGPSSGAPPPSGGGGSGGGGSGGGGSAESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 199 - protein, 477 aa, Artificial Sequence
  The amino acid sequence of C488 L9F9L9M2
HSQGTFTSDLSKYLEGQAAQDFVQWMNTGPSSGAPPPSGGGGSGGGGSGGGGSESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 200 - protein, 469 aa, Artificial Sequence
  The amino acid sequence of C498 L13F4L13M4
HSQGTFTSDYSEYLDSERARDFVAWLEAGGGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 201 - protein, 473 aa, Artificial Sequence
  The amino acid sequence of C503 L15F2L9M5
HSQGTFTSDYSKYLEEEAVRLFIQWLMNTGSGGGGSGGGGSGGGGSEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSHPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 202 - protein, 469 aa, Artificial Sequence
  The amino acid sequence of C508 L7F4L9M3
HSQGTFTSDYSKYLEEEAVRLFIQWLMNGGPSSGAPPPSGGSGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 203 - protein, 476 aa, Artificial Sequence
  The amino acid sequence of C711 L13F5L10M4
HSQGTFTSDYSKYLDSQAAQDFVQWLMNTKRNRNNIAGGGGSGGGGSGGGGSAERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 204 - protein, 475 aa, Artificial Sequence
  The amino acid sequence of C708 L10F4L14M7
HSQGTFTSDYSKYLDSEAAQDFVQWLMNTKRNRNNIAGGGGAGGGGAGGGGADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGASHPIPDSSPLLQFGGQVRQEYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 205 - protein, 477 aa, Artificial Sequence
  The amino acid sequence of C743 L18F7L8M10
HSQGTFTSDYSKYLDSQEAQDFVQWLMNTKRNRNNIAGSGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGSGGGAGGGGSDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 206 - protein, 485 aa, Artificial Sequence
  The amino acid sequence of C756 L20F4L10M8
HSQGTFTSDYSKYLDEQAAQDFVQWLMNTKRNRNNIAGGGGSGGGGSGGGGSGGGGSGGGGSADKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 207 - protein, 460 aa, Artificial Sequence
  The amino acid sequence of C788 L1F5L5M5
HSQGTFTSDYSKQMDSQRAQDFVQWLMNTKRNRNNIAGGGGSERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSHPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 208 - protein, 474 aa, Artificial Sequence
  The amino acid sequence of C731 L5F2L9M9
HSQGTFTSDLSKQMDSRAAQDFIEWLKNTKRNRNNIAGGGGSGGGGSEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 209 - protein, 424 aa, Artificial Sequence
  The amino acid sequence of the long-acting FGF21 analogue F9L10W
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 210 - protein, 424 aa, Artificial Sequence
  The amino acid sequence of the long-acting FGF21 analogue F9L10M1
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 211 - protein, 424 aa, Artificial Sequence
  The amino acid sequence of the long-acting FGF21 analogue F9L10M2
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 212 - protein, 420 aa, Artificial Sequence
  The amino acid sequence of the long-acting FGF21 analogue F9L10M3
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGADSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHCPGNKSPHRDPAPRGPCRFLPLPGLPPALPEPPGILAPQPPDVGSSDPLAMVGPSQGRSPSYAS

SEQ ID NO: 213 - protein, 424 aa, Artificial Sequence
  The amino acid sequence of the long-acting FGF21 analogue F9L10M4
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYES

SEQ ID NO: 214 - protein, 424 aa, Artificial Sequence
  The amino acid sequence of the long-acting FGF21 analogue F9L10M5
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAEDQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 215 - protein, 424 aa, Artificial Sequence
  The amino acid sequence of the long-acting FGF21 analogue F9L10M6
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVEPSQGRSPSYAS

SEQ ID NO: 216 - protein, 424 aa, Artificial Sequence
  The amino acid sequence of the long-acting FGF21 analogue F9L10M7
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQEYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 217 - protein, 424 aa, Artificial Sequence
  The amino acid sequence of the long-acting FGF21 analogue F9L10M8
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSAAS

SEQ ID NO: 218 - protein, 424 aa, Artificial Sequence
  The amino acid sequence of the long-acting FGF21 analogue F9L10M9
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 219 - protein, 420 aa, Artificial Sequence
  The amino acid sequence of the long-acting FGF21 analogue F9L10M10
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGADSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLAMVGGSQGRSPSYAS

SEQ ID NO: 220 - protein, 424 aa, Artificial Sequence
  The amino acid sequence of the long-acting FGF21 analogue F9L10M11
ESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLAMVGGSQGRSPSYES

SEQ ID NO: 221 - protein, 424 aa, Artificial Sequence; identical to SEQ ID NO: 218
  The amino acid sequence of the long-acting FGF21 analogue F9L10M12

SEQ ID NO: 222 - DNA, 819 bp, Artificial Sequence
  The nucleotide sequence of C001L13F8
cacagccagggcaccttcaccagcgactacagcaagtacctggacagccggcgggcccaggacttcgtgcagtggctgatgaacaccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 223 - DNA, 849 bp, Artificial Sequence
  The nucleotide sequence of C002L13F8
cacagccagggcaccttcaccagcgactacagcaagtacctggacagccggcgggcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 224 - DNA, 819 bp, Artificial Sequence
  The nucleotide sequence of CG283L13F8
cacagccagggcaccttcaccagcgactacagcaagtacctggacgagcgggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 225 - DNA, 849 bp, Artificial Sequence
  The nucleotide sequence of C240L13F8
cacagccagggcaccttcaccagcgactacagcaagtacctggacgagcgggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 226 - DNA, 819 bp, Artificial Sequence
  The nucleotide sequence of CG214L13F8
cacagccagggcaccttcaccagcgactacagcaagtacctggacagccaggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 227 - DNA, 849 bp, Artificial Sequence
  The nucleotide sequence of C382L13F8
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 228 - DNA, 819 bp, Artificial Sequence
  The nucleotide sequence of CG267L13F8
cacagccagggcaccttcaccagcgactacagcaagtacctggacagccgggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 229 - DNA, 849 bp, Artificial Sequence
  The nucleotide sequence of C276L13F8
cacagccagggcaccttcaccagcgactacagcaagtacctggacagccgggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 230 - DNA, 819 bp, Artificial Sequence
  The nucleotide sequence of C308L13F8
cacagccagggcaccttcaccagcgactacagcaagtacctggacgagcaggccgcccaggacttcgtgcagtggctgatgaacaccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 231 - DNA, 849 bp, Artificial Sequence
  The nucleotide sequence of C368L13F8
cacagccagggcaccttcaccagcgactacagcaagtacctggacgagcaggccgcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 232 - DNA, 819 bp, Artificial Sequence
  The nucleotide sequence of C224L13F8
cacagccagggcaccttcaccagcgactacagcaagtacctggacgagcgggccgcccaggacttcgtgcagtggctgatgaacaccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 233 - DNA, 849 bp, Artificial Sequence
  The nucleotide sequence of C225L13F8
cacagccagggcaccttcaccagcgactacagcaagtacctggacgagcgggccgcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 234 - DNA, 819 bp, Artificial Sequence
  The nucleotide sequence of CG308L13F8
cacagccagggcaccttcaccagcgactacagcaagtacctggacgagcaggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 235 - DNA, 849 bp, Artificial Sequence
  The nucleotide sequence of C495L13F8
cacagccagggcaccttcaccagcgactacagcaagtacctggacgagcaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 236 - DNA, 819 bp, Artificial Sequence
  The nucleotide sequence of C319L13F8
cacagccagggcaccttcaccagcgactacagcaagtacctggacggccaggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 237 - DNA, 849 bp, Artificial Sequence
  The nucleotide sequence of C364L13F8
cacagccagggcaccttcaccagcgactacagcaagtacctggacggccaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 238 - DNA, 819 bp, Artificial Sequence
  The nucleotide sequence of C214L13F8
cacagccagggcaccttcaccagcgactacagcaagtacctggacagccaggccgcccaggacttcgtgcagtggctgatgaacaccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 239 - DNA, 849 bp, Artificial Sequence
  The nucleotide sequence of C232L13F8
cacagccagggcaccttcaccagcgactacagcaagtacctggacagccaggccgcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 240 - DNA, 819 bp, Artificial Sequence
  The nucleotide sequence of C303L13F8
cacagccagggcaccttcaccagcgactacagcaagtacctggacgaggaggccgcccaggacttcgtgcagtggctgatgaacaccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 241 - DNA, 849 bp, Artificial Sequence
  The nucleotide sequence of C392L13F8
cacagccagggcaccttcaccagcgactacagcaagtacctggacgaggaggccgcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 242 - DNA, 819 bp, Artificial Sequence
  The nucleotide sequence of CG303L13F8
cacagccagggcaccttcaccagcgactacagcaagtacctggacgaggaggccgcccaggacttcgtgcagtggctgatgaacggcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 243 - DNA, 849 bp, Artificial Sequence
  The nucleotide sequence of C462L13F8
cacagccagggcaccttcaccagcgactacagcaagtacctggacgaggaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 244 - DNA, 849 bp, Artificial Sequence
  The nucleotide sequence of C240 L12F8
cacagccagggcaccttcaccagcgactacagcaagtacctggacgagcgggccgcccaggacttcgtgcagtggctgatgaacggcggccccagcagcggcgcccccccccccagcggaggaggaggagctggcggcggcggcgcgggtggtggtggcgccgccgagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 245 - DNA, 840 bp, Artificial Sequence
  The nucleotide sequence of C368 L10F4
cacagccagggcaccttcaccagcgactacagcaagtacctggacgagcaggccgcccaggacttcgtgcagtggctgatgaacaccggccccagcagcggcgcccccccccccagcggcggcggcggcgccggcggcggcggcgccggcggcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 246 - DNA, 840 bp, Artificial Sequence
  The nucleotide sequence of C364 L10F4
cacagccagggcaccttcaccagcgactacagcaagtacctggacggccaggccgcccaggacttcgtgcagtggctgatgaacggcggccccagcagcggcgcccccccccccagcggcggcggcggcgccggcggcggcggcgccggcggcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 247 - DNA, 840 bp, Artificial Sequence
  The nucleotide sequence of C352 L13F4
cacagccagggcaccttcaccagcgactacagcaagtacctggacgagcaggccgcccaggacttcgtgcagtggctgatgaacggccccagcagcggcgcccccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 248 - DNA, 846 bp, Artificial Sequence
  The nucleotide sequence of C225 L10F10
cacagccagggcaccttcaccagcgactacagcaagtacctggacgagcgggccgcccaggacttcgtgcagtggctgatgaacaccggccccagcagcggcgcccccccccccagcggaggaggaggagctggcggcggcggcgcgggtggtggtggcgccgagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggt

SEQ ID NO: 249 - DNA, 843 bp, Artificial Sequence
  The nucleotide sequence of C228L13F4
cacagccagggcaccttcaccagcgactacagcaagtacctggacgaggagcgggcccaggacttcgtgcagtggctgatgaacaccggccccagcagcggcgcccccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 250 - DNA, 840 bp, Artificial Sequence
  The nucleotide sequence of C187 L9F4
cacagccagggcaccttcaccagcgactacagcaagtacctggacagccagcgggcccaggacttcgtgcagtggctgatgaacaccggccccagcagcggcgcccccccccccagcggcggcggcggcagcggcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 251 - DNA, 843 bp, Artificial Sequence
  The nucleotide sequence of C618 L12F4
cacagccagggcaccttcaccagcgacctgagcaagcagatggacagccgggccgcccaggacttcatcgagtggctgaagaacggcggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 252 - DNA, 843 bp, Artificial Sequence
  The nucleotide sequence of C623 L9F3
cacagccagggcaccttcaccagcgacctgagcaagcagatggacagccgggaggcccaggacttcatcgagtggctgaagaacaccggccccagcagcggcgcccccccccccagcggcggcggcggcagcggcggcggcggcagcggcggcggcggcagcgacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgctagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 253 - DNA, 843 bp, Artificial Sequence; identical to SEQ ID NO: 249
  The nucleotide sequence of C228 L13F4

SEQ ID NO: 254 - DNA, 816 bp, Artificial Sequence
  The nucleotide sequence of C498 L13F4
cacagccagggcaccttcaccagcgactacagcgagtacctggacagcgagcgggcccgggacttcgtggcctggctggaggccggcggcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 255 - DNA, 831 bp, Artificial Sequence
  The nucleotide sequence of C503 L15F2
cacagccagggcaccttcaccagcgactacagcaagtacctggaggaggaggccgtgcggctgttcatccagtggctgatgaacaccggcagcggcggcggcggcagcggcggcggcggcagcggcggcggcggcagcgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 256 - DNA, 831 bp, Artificial Sequence
  The nucleotide sequence of C508 L7F4
cacagccagggcaccttcaccagcgactacagcaagtacctggaggaggaggccgtgcggctgttcatccagtggctgatgaacggcggccccagcagcggcgcccccccccccagcggcggcagcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 257 - DNA, 867 bp, Artificial Sequence
  The nucleotide sequence of C756 L20F4
cacagccagggcaccttcaccagcgactacagcaagtacctggacgagcaggccgcccaggacttcgtgcagtggctgatgaacaccaagcggaaccggaacaacatcgccggcggcggcggcagcggcggcggcggcagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 258 - DNA, 807 bp, Artificial Sequence
  The nucleotide sequence of C788 L1F5
cacagccagggcaccttcaccagcgactacagcaagcagatggacagccagcgggcccaggacttcgtgcagtggctgatgaacaccaagcggaaccggaacaacatcgccggcggcggcggcagcgagcggaagtgctgcgtggagtgccccccctgccccgccccccccgtggccggccccagcgtgttcctgttcccccccaagcccaaggacaccctgatgatcagccggacccccgaggtgacctgcgtggtggtggacgtgagccacgaggaccccgaggtgcagttcaactggtacgtggacggcgtggaggtgcacaacgccaagaccaagccccgggaggagcagttcaacagcaccttccgggtggtgagcgtgctgaccgtggtgcaccaggactggctgaacggcaaggagtacaagtgcaaggtgagcaacaagggcctgcccagcagcatcgagaagaccatcagcaagaccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 259 - DNA, 843 bp, Artificial Sequence
  The nucleotide sequence of C289 L12F4
cacagccagggcaccttcaccagcgactacagcaagtacctggacggcgaggccgcccaggacttcgtgcagtggctgatgaacggcggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 260 - DNA, 840 bp, Artificial Sequence
  The nucleotide sequence of C611 L11F4
cacagccagggcaccttcaccagcgactacagcaagtacctggacgagcgggccgcccaggacttcgtgcagtggctgctggacggccccagcagcggcgcccccccccccagcggcggcagcggcggcggcggcagcggcggcggcggcagcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggc

SEQ ID NO: 261 - DNA, 849 bp, Artificial Sequence
  The nucleotide sequence of C209 L13F8
cacagccagggcaccttcaccagcgactacagcaagtacctggacagcgaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggt

SEQ ID NO: 262 - DNA, 849 bp, Artificial Sequence
  The nucleotide sequence of C627 L12F10
cacagccagggcaccttcaccagcgactacagcaagcagatggacagccagcgggcccaggacttcgtgcagtggctgatgaacggcggccccagcagcggcgcccccccccccagcggcggcggcggcgccggcggcggcggcgccggcggcggcggcgccgccgagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggt

SEQ ID NO: 263 - DNA, 1437 bp, Artificial Sequence
  The nucleotide sequence of C002L13F8L10W
cacagccagggcaccttcaccagcgactacagcaagtacctggacagccggcgggcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggccccagccagggccggagccccagctacgccagc

SEQ ID NO: 264 - DNA, 1440 bp, Artificial Sequence
  The nucleotide sequence of C240 L12F8L12M1
cacagccagggcaccttcaccagcgactacagcaagtacctggacgagcgggccgcccaggacttcgtgcagtggctgatgaacggcggccccagcagcggcgcccccccccccagcggaggaggaggagctggcggcggcggcgcgggtggtggtggcgccgccgagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggaggaggaggagctggcggcggcggcgcgggtggtggtggcgccgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 265 - DNA, 1440 bp, Artificial Sequence
  The nucleotide sequence of C240 L9F7L13M2
cacagccagggcaccttcaccagcgactacagcaagtacctggacgagcgggccgcccaggacttcgtgcagtggctgatgaacggcggccccagcagcggcgcccccccccccagcggtggtggtggttctggaggaggaggcagtggcggtggcggatcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtaagggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 266 - DNA, 1431 bp, Artificial Sequence
  The nucleotide sequence of C240 L13F4L9M1
cacagccagggcaccttcaccagcgactacagcaagtacctggacgagcgggccgcccaggacttcgtgcagtggctgatgaacggcggccccagcagcggcgcccccccccccagcggtggtggtggttctggaggaggaggcagtggcggtggcggatcagcagacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 267 - DNA, 1434 bp, Artificial Sequence
  The nucleotide sequence of C240 L9F2L13M3
cacagccagggcaccttcaccagcgactacagcaagtacctggacgagcgggccgcccaggacttcgtgcagtggctgatgaacggcggccccagcagcggcgcccccccccccagcggcggcggcggcagcggcggcggcggcagcggcggcggcggcagcgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggtggtggtggttctggaggaggaggcagtggcggtggcggatcagcagacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 268 - DNA, 1437 bp, Artificial Sequence
  The nucleotide sequence of C240 L13F10L9M2
cacagccagggcaccttcaccagcgactacagcaagtacctggacgagcgggccgcccaggacttcgtgcagtggctgatgaacggcggccccagcagcggcgcccccccccccagcggtggtggtggttctggaggaggaggcagtggcggtggcggatcagcagagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 269 - DNA, 1437 bp, Artificial Sequence
  The nucleotide sequence of C225 L10F10L14M2
cacagccagggcaccttcaccagcgactacagcaagtacctggacgagcgggccgcccaggacttcgtgcagtggctgatgaacaccggccccagcagcggcgcccccccccccagcggaggaggaggagctggcggcggcggcgcgggtggtggtggcgccgagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcctctcaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 270 - DNA, 1440 bp, Artificial Sequence
  The nucleotide sequence of C163 L13F8L13M2
cacagccagggcaccttcaccagcgactacagcaagtacctggacagccgggccgcccaggacttcgtgcagtggctgatgaacaccggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 271 - DNA, 1419 bp, Artificial Sequence
  The nucleotide sequence of C271 L9F4L8M2
cacagccagggcaccttcaccagcgactacagcaagtacctggacggccgggccgcccaggacttcgtgcagtggctgatgaacaccggccccagcagcggcgcccccccccccagcggcggcggcggcagcggcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcagcggcggcggcgccggcggcggcggcagccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 272 - DNA, 1428 bp, Artificial Sequence
  The nucleotide sequence of C368 L10F4L10M2
cacagccagggcaccttcaccagcgactacagcaagtacctggacgagcaggccgcccaggacttcgtgcagtggctgatgaacaccggccccagcagcggcgcccccccccccagcggcggcggcggcgccggcggcggcggcgccggcggcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 273 - DNA, 1440 bp, Artificial Sequence
  The nucleotide sequence of C495 L13F8L13M1
cacagccagggcaccttcaccagcgactacagcaagtacctggacgagcaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 274 - DNA, 1437 bp, Artificial Sequence
  The nucleotide sequence of C495 L13F8L10M2
cacagccagggcaccttcaccagcgactacagcaagtacctggacgagcaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 275 - DNA, 1434 bp, Artificial Sequence
  The nucleotide sequence of C495 L9F10L9M1
cacagccagggcaccttcaccagcgactacagcaagtacctggacgagcaggccgcccaggacttcgtgcagtggctgatgaacggcggccccagcagcggcgcccccccccccagcggtggtggtggttctggaggaggaggcagtggcggtggcggatcagagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 276 - DNA, 1428 bp, Artificial Sequence
  The nucleotide sequence of C353 L13F3L10M4
cacagccagggcaccttcaccagcgactacagcaagtacctggacgagcaggccgcccaggacttcgtgcagtggctgatgaacggccccagcagcggcgccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagggcggcggcggcgccggcggcggcggcgccggcggcggcggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 277 - DNA, 1416 bp, Artificial Sequence
  The nucleotide sequence of C352 L13F4L9M3
cacagccagggcaccttcaccagcgactacagcaagtacctggacgagcaggccgcccaggacttcgtgcagtggctgatgaacggccccagcagcggcgcccccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 278 - DNA, 1431 bp, Artificial Sequence
  The nucleotide sequence of C382 L9F3L9M2
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgctagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 279 - DNA, 1446 bp, Artificial Sequence
  The nucleotide sequence of C382 L10F2L13M2
cacagccagggcaccttcaccagcgactacagcaagtacctggacagccaggccgcccaggacttcgtgcagtggctgatgaacggcggccccagcagcggcgcccccccccccagcggcggcggcggcgccggcggcggcggcgccggcggcggcggcgccgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 280 - DNA, 1437 bp, Artificial Sequence
  The nucleotide sequence of C382 L13F10L9M1
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagcagagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttgcttccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 281 - DNA, 1437 bp, Artificial Sequence
  The nucleotide sequence of C382 L13F8L10M2
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 282 - DNA, 1440 bp, Artificial Sequence
  The nucleotide sequence of C382 L12F7L9M2
cattcccaaggtacctttacttctgattactctaaatacttggattctcaagcggcccaggattttgtgcagtggctgatgaacggcggtccctcttctggtgctccaccaccttccggaggaggaggagctggcggcggcggcgcgggtggtggtggcgccgccgagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtaagggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 283 - DNA, 1431 bp, Artificial Sequence
  The nucleotide sequence of C382 L14F4L9M2
cattcccaaggtacctttacttctgattactctaaatacttggattctcaagcggcccaggattttgtgcagtggctgatgaacggcggtccctcttctggtgctccaccaccttccggcggcggcggcgccggcggcggcggcgccggcggcggcggcgccagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 284 - DNA, 1419 bp, Artificial Sequence
  The nucleotide sequence of C232 L9F3L10M3
cacagccagggcaccttcaccagcgactacagcaagtacctggacagccaggccgcccaggacttcgtgcagtggctgatgaacaccggccccagcagcggcgcccccccccccagcggcggcggcggcagcggcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagggcggcggcggcgccggcggcggcggcgccggcggcggcggcgccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 285 - DNA, 1434 bp, Artificial Sequence
  The nucleotide sequence of C227 L12F5L14M4
cacagccagggcaccttcaccagcgactacagcaagtacctggacagccaggccgcccaggacttcgtgcagtggctgatgaacaccggccccagcagcggcgccccccccagcggcggcggcggcgccggcggcggcggcgccggcggcggcggcgccgccgagcggaagtgctgcgtggagtgccccccctgccccgccccccccgtggccggccccagcgtgttcctgttcccccccaagcccaaggacaccctgatgatcagccggacccccgaggtgacctgcgtggtggtggacgtgagccacgaggaccccgaggtgcagttcaactggtacgtggacggcgtggaggtgcacaacgccaagaccaagccccgggaggagcagttcaacagcaccttccgggtggtgagcgtgctgaccgtggtgcaccaggactggctgaacggcaaggagtacaagtgcaaggtgagcaacaagggcctgcccagcagcatcgagaagaccatcagcaagaccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 286 - DNA, 1440 bp, Artificial Sequence
  The nucleotide sequence of C266 L13F7L13M4
cacagccagggcaccttcaccagcgactacagcaagtacctggacagccaggccgcccaggacttcgtgcagtggctgatgaacggccccagcagcggcgcccccccccccagcggcggcggcggcagcggcggcggcggcagcggcggcggcggcagcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcggcggcggcagcggcggcggcggcagcggcggcggcggcagcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 287 - DNA, 1434 bp, Artificial Sequence
  The nucleotide sequence of C137 L10F8L9M5
cacagccagggcaccttcaccagcgactacagcaagtacctggacagcgagcgggcccaggacttcgtgcagtggctgatgaacaccggccccagcagcggcgcccccccccccagcggcggcggcggcgccggcggcggcggcgccggcggcggcggcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgaggaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 288 - DNA, 1461 bp, Artificial Sequence
  The nucleotide sequence of C399 L12F4L19M8
cacagccagggcaccttcaccagcgactacagcaagtacctggacggcgagcgggcccaggacttcgtgcagtggctgatgaacaccggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagcgccgccagc

SEQ ID NO: 289 - DNA, 1440 bp, Artificial Sequence
  The nucleotide sequence of C392 L11F7L10M5
cacagccagggcaccttcaccagcgactacagcaagtacctggacgaggaggccgcccaggacttcgtgcagtggctgatgaacaccggccccagcagcggcgcccccccccccagcggcggcagcggcggcggcggcagcggcggcggcggcagcggcggcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcggcggcggcgccggcggcggcggcgccggcggcggcggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgaggaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 290 - DNA, 1431 bp, Artificial Sequence
  The nucleotide sequence of C462 L9F2L9M10
cacagccagggcaccttcaccagcgactacagcaagtacctggacgaggaggccgcccaggacttcgtgcagtggctgatgaacggcggccccagcagcggcgcccccccccccagcggcggcggcggcagcggcggcggcggcagcggcggcggcggcagcgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 291 - DNA, 1419 bp, Artificial Sequence
  The nucleotide sequence of C462 L10F5L10M3
cacagccagggcaccttcaccagcgactacagcaagtacctggacgaggaggccgcccaggacttcgtgcagtggctgatgaacggcggccccagcagcggcgcccccccccccagcggcggcggcggcgccggcggcggcggcgccggcggcggcggcgccgagcggaagtgctgcgtggagtgccccccctgccccgccccccccgtggccggccccagcgtgttcctgttcccccccaagcccaaggacaccctgatgatcagccggacccccgaggtgacctgcgtggtggtggacgtgagccacgaggaccccgaggtgcagttcaactggtacgtggacggcgtggaggtgcacaacgccaagaccaagccccgggaggagcagttcaacagcaccttccgggtggtgagcgtgctgaccgtggtgcaccaggactggctgaacggcaaggagtacaagtgcaaggtgagcaacaagggcctgcccagcagcatcgagaagaccatcagcaagaccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 292 - DNA, 1440 bp, Artificial Sequence
  The nucleotide sequence of C462 L11F8L13M1
cacagccagggcaccttcaccagcgactacagcaagtacctggacgaggaggccgcccaggacttcgtgcagtggctgatgaacggcggccccagcagcggcgcccccccccccagcggcggcagcggcggcggcggcagcggcggcggcggcagcggcggcgccgagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 293 - DNA, 1431 bp, Artificial Sequence
  The nucleotide sequence of C462 L13F4L10M2
cacagccagggcaccttcaccagcgactacagcaagtacctggacgaggaggccgcccaggacttcgtgcagtggctgatgaacggcggccccagcagcggcgcccccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 294 - DNA, 1437 bp, Artificial Sequence
  The nucleotide sequence of C462 L13F8L10M2
cacagccagggcaccttcaccagcgactacagcaagtacctggacgaggaggccgcccaggacttcgtgcagtggctgatgaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 295 - DNA, 1437 bp, Artificial Sequence
  The nucleotide sequence of C462 L13F10L9M4
cacagccagggcaccttcaccagcgactacagcaagtacctggacgaggaggccgcccaggacttcgtgcagtggctgatgaacggcggccccagcagcggcgcccccccccccagcggcggcggcggcagcggcggcggcggcagcggcggcggcggcagcgccgagagcaagtacggccccccctgccccccctgccccgcccccgaggccgccggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 296 - DNA, 1434 bp, Artificial Sequence
  The nucleotide sequence of C228 L13F4L13M12
cacagccagggcaccttcaccagcgactacagcaagtacctggacgaggagcgggcccaggacttcgtgcagtggctgatgaacaccggccccagcagcggcgcccccccccccagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 297 - DNA, 1431 bp, Artificial Sequence
  The nucleotide sequence of C187 L9F4L12M7
cacagccagggcaccttcaccagcgactacagcaagtacctggacagccagcgggcccaggacttcgtgcagtggctgatgaacaccggccccagcagcggcgcccccccccccagcggcggcggcggcagcggcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccgcccaccccatccccgacagcagccccctgctgcagttcggcggccaggtgcggcaggagtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 298 - DNA, 1431 bp, Artificial Sequence
  The nucleotide sequence of C364 L10F4L12M8
cacagccagggcaccttcaccagcgactacagcaagtacctggacggccaggccgcccaggacttcgtgcagtggctgatgaacggcggccccagcagcggcgcccccccccccagcggcggcggcggcgccggcggcggcggcgccggcggcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagcgccgccagc

SEQ ID NO: 299 - DNA, 1440 bp, Artificial Sequence
  The nucleotide sequence of C209 L13F8L13M9
cacagccagggcaccttcaccagcgactacagcaagtacctggacagcgaggccgcccaggacttcgtgcagtggctgatgaacggcggccccagcagcggcgcccccccccccagcggcggcggcggcagcggcggcggcggcagcggcggcggcggcagcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcagcggcggcggcggcagcggcggcggcggcagcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 300 - DNA, 1410 bp, Artificial Sequence
  The nucleotide sequence of C289 L12F4L8M10
cacagccagggcaccttcaccagcgactacagcaagtacctggacggcgaggccgcccaggacttcgtgcagtggctgatgaacggcggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcagcggcggcggcgccggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 301 - DNA, 1431 bp, Artificial Sequence
  The nucleotide sequence of C611 L11F4L11M11
cacagccagggcaccttcaccagcgactacagcaagtacctggacgagcgggccgcccaggacttcgtgcagtggctgctggacggccccagcagcggcgcccccccccccagcggcggcagcggcggcggcggcagcggcggcggcggcagcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcagcggcggcggcggcagcggcggcggcggcagcggcggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 302 - DNA, 1443 bp, Artificial Sequence
  The nucleotide sequence of C618 L13F7L13M1
cacagccagggcaccttcaccagcgacctgagcaagcagatggacagccgggccgcccaggacttcatcgagtggctgaagaacggcggccccagcagcggcgcccccccccccagcggtggtggtggttctggaggaggaggcagtggcggtggcggatcagcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtaagggtggtggtggttctggaggaggaggcagtggcggtggcggatcagcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 303 - DNA, 1434 bp, Artificial Sequence
  The nucleotide sequence of C618 L12F4L12M2
cacagccagggcaccttcaccagcgacctgagcaagcagatggacagccgggccgcccaggacttcatcgagtggctgaagaacggcggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 304 - DNA, 1431 bp, Artificial Sequence
  The nucleotide sequence of C623 L9F3L10M1
cacagccagggcaccttcaccagcgacctgagcaagcagatggacagccgggaggcccaggacttcatcgagtggctgaagaacaccggccccagcagcggcgcccccccccccagcggcggcggcggcagcggcggcggcggcagcggcggcggcggcagcgacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgctagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 305 - DNA, 1434 bp, Artificial Sequence
  The nucleotide sequence of C623 L9F8L9M2
cacagccagggcaccttcaccagcgacctgagcaagcagatggacagccgggaggcccaggacttcatcgagtggctgaagaacaccggccccagcagcggcgcccccccccccagcggtggtggtggttctggaggaggaggcagtggcggtggcggatcagagtccaaatatggtcccccatgcccaccttgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcgctagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctttaggtggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 306 - DNA, 1437 bp, Artificial Sequence
  The nucleotide sequence of C627 L12F10L9M6
cacagccagggcaccttcaccagcgactacagcaagcagatggacagccagcgggcccaggacttcgtgcagtggctgatgaacggcggccccagcagcggcgcccccccccccagcggcggcggcggcgccggcggcggcggcgccggcggcggcggcgccgccgagagcaagtacggccccccctgccccccctgccccgcccccgaggccgccggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtggagcccagccagggccggagccccagctacgccagc

SEQ ID NO: 307 - DNA, 1410 bp, Artificial Sequence
  The nucleotide sequence of C654 L13F9L6M3
cacagccagggcaccttcaccagcgactacagcaagcagctggacagccagcgggcccaggacttcgtgcagtggctgatgaacggcggccccagcagcggcgcccccccccccagcggcggcggcggcagcggcggcggcggcagcggcggcggcggcagcgccgagagcaagtacggccccccctgccccccctgccccgcccccgaggccgccggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcaacagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcgccggcggcggcggcgccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 308 - DNA, 1413 bp, Artificial Sequence
  The nucleotide sequence of C673 L8F3L8M8
cacagccagggcaccttcaccagcgactacagcaagtacctggacgaggaggccgcccaggacttcatcgagtggctgaagaacaccggccccagcagcggcgcccccccccccagcggcggcagcggcggcggcgccggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagggcggcagcggcggcggcgccggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagcgccgccagc

SEQ ID NO: 309 - DNA, 1425 bp, Artificial Sequence
  The nucleotide sequence of C563 L14F8L9M3
cacagccagggcaccttcaccagcgactacagcagctacctggacgaggaggccgcccaggacttcatcgagtggctgaagaacaccggccccagcagcggcgcccccccccccagcggcggcggcggcgccggcggcggcggcgccggcggcggcggcgccagcgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcggcggcggcggcagcggcggcggcggcagcggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 310 - DNA, 1428 bp, Artificial Sequence
  The nucleotide sequence of C549 L12F4L9M4
cacagccagggcaccttcaccagcgacgtgagcaagtacctggagagccgggccgcccaggacttcgtgcagtggatgaacggcggccccagcagcggcgcccccccccccagcggcggcggcggcgccggcggcggcggcgccggcggcggcggcgccgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 311 - DNA, 1437 bp, Artificial Sequence
  The nucleotide sequence of C555 L10F6L12M1
cacagccagggcaccttcaccagcgacctgagcaagtacctggaggagcaggccgcccaggacttcgtgcagtggatgaacggcggccccagcagcggcgcccccccccccagcggcggcggcggcgccggcggcggcggcgccggcggcggcggcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcaacagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcggcggcggcgccggcggcggcggcgccggcggcggcggcgccgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 312 - DNA, 1440 bp, Artificial Sequence
  The nucleotide sequence of C487 L13F7L13M4
cacagccagggcaccttcaccagcgacctgagcaagtacctggagggccaggccgcccaggacttcgtgcagtggatgaacggcggccccagcagcggcgcccccccccccagcggcggcggcggcagcggcggcggcggcagcggcggcggcggcagcgccgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcggcggcggcagcggcggcggcggcagcggcggcggcggcagcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 313 - DNA, 1431 bp, Artificial Sequence
  The nucleotide sequence of C488 L9F9L9M2
cacagccagggcaccttcaccagcgacctgagcaagtacctggagggccaggccgcccaggacttcgtgcagtggatgaacaccggccccagcagcggcgcccccccccccagcggtggtggtggttctggaggaggaggcagtggcggtggcggatcagagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggtggtggtggttctggaggaggaggcagtggcggtggcggatcacaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 314 - DNA, 1407 bp, Artificial Sequence
  The nucleotide sequence of C498 L13F4L13M4
cacagccagggcaccttcaccagcgactacagcgagtacctggacagcgagcgggcccgggacttcgtggcctggctggaggccggcggcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 315 - DNA, 1419 bp, Artificial Sequence
  The nucleotide sequence of C503 L15F2L9M5
cacagccagggcaccttcaccagcgactacagcaagtacctggaggaggaggccgtgcggctgttcatccagtggctgatgaacaccggcagcggcggcggcggcagcggcggcggcggcagcggcggcggcggcagcgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgaggaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 316 - DNA, 1407 bp, Artificial Sequence
  The nucleotide sequence of C508 L7F4L9M3
cacagccagggcaccttcaccagcgactacagcaagtacctggaggaggaggccgtgcggctgttcatccagtggctgatgaacggcggccccagcagcggcgcccccccccccagcggcggcagcggcggcggcagcggcggcggcggcagcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 317 - DNA, 1428 bp, Artificial Sequence
  The nucleotide sequence of C711 L13F5L10M4
cacagccagggcaccttcaccagcgactacagcaagtacctggacagccaggccgcccaggacttcgtgcagtggctgatgaacaccaagcggaaccggaacaacatcgccggcggcggcggcagcggcggcggcggcagcggcggcggcggcagcgccgagcggaagtgctgcgtggagtgccccccctgccccgccccccccgtggccggccccagcgtgttcctgttcccccccaagcccaaggacaccctgatgatcagccggacccccgaggtgacctgcgtggtggtggacgtgagccacgaggaccccgaggtgcagttcaactggtacgtggacggcgtggaggtgcacaacgccaagaccaagccccgggaggagcagttcaacagcaccttccgggtggtgagcgtgctgaccgtggtgcaccaggactggctgaacggcaaggagtacaagtgcaaggtgagcaacaagggcctgcccagcagcatcgagaagaccatcagcaagaccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 318 - DNA, 1425 bp, Artificial Sequence
  The nucleotide sequence of C708 L10F4L14M7
cacagccagggcaccttcaccagcgactacagcaagtacctggacagcgaggccgcccaggacttcgtgcagtggctgatgaacaccaagcggaaccggaacaacatcgccggcggcggcggcgccggcggcggcggcgccggcggcggcggcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgccagccaccccatccccgacagcagccccctgctgcagttcggcggccaggtgcggcaggagtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 319 - DNA, 1431 bp, Artificial Sequence
  The nucleotide sequence of C743 L18F7L8M10
cacagccagggcaccttcaccagcgactacagcaagtacctggacagccaggaggcccaggacttcgtgcagtggctgatgaacaccaagcggaaccggaacaacatcgccggcagcggcggcggcggcagcggcggcggcggcagcggcggcggcggcagcggcggcggcggcagcgagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcgccagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcggcagcggcggcggcgccggcggcggcggcagcgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 320 - DNA, 1455 bp, Artificial Sequence
  The nucleotide sequence of C756 L20F4L10M8
cacagccagggcaccttcaccagcgactacagcaagtacctggacgagcaggccgcccaggacttcgtgcagtggctgatgaacaccaagcggaaccggaacaacatcgccggcggcggcggcagcggcggcggcggcagcggcggcggcggcagcggcggcggcggcagcggcggcggcggcagcgccgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacggcagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcgccggcggcggcggcgccggcggcggcggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagcgccgccagc

SEQ ID NO: 321 - DNA, 1380 bp, Artificial Sequence
  The nucleotide sequence of C788 L1F5L5M5
cacagccagggcaccttcaccagcgactacagcaagcagatggacagccagcgggcccaggacttcgtgcagtggctgatgaacaccaagcggaaccggaacaacatcgccggcggcggcggcagcgagcggaagtgctgcgtggagtgccccccctgccccgccccccccgtggccggccccagcgtgttcctgttcccccccaagcccaaggacaccctgatgatcagccggacccccgaggtgacctgcgtggtggtggacgtgagccacgaggaccccgaggtgcagttcaactggtacgtggacggcgtggaggtgcacaacgccaagaccaagccccgggaggagcagttcaacagcaccttccgggtggtgagcgtgctgaccgtggtgcaccaggactggctgaacggcaaggagtacaagtgcaaggtgagcaacaagggcctgcccagcagcatcgagaagaccatcagcaagaccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgaggaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 322 - DNA, 1422 bp, Artificial Sequence
  The nucleotide sequence of C731 L5F2L9M9
cacagccagggcaccttcaccagcgacctgagcaagcagatggacagccgggccgcccaggacttcatcgagtggctgaagaacaccaagcggaaccggaacaacatcgccggcggcggcggcagcggcggcggcggcagcgagcccaagagctgcgacaagacccacacctgccccccctgccccgcccccgagctgctgggcggccccagcgtgttcctgttcccccccaagcccaaggacaccctgatgatcagccggacccccgaggtgacctgcgtggtggtggacgtgagccacgaggaccccgaggtgaagttcaactggtacgtggacggcgtggaggtgcacaacgccaagaccaagccccgggaggagcagtacgccagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcggcggcggcggcagcggcggcggcggcagcggcggcggcggcagccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 323 - DNA, 1272 bp, Artificial Sequence
  The nucleotide sequence of F9L10W
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggccccagccagggccggagccccagctacgccagc

SEQ ID NO: 324 - DNA, 1272 bp, Artificial Sequence
  The nucleotide sequence of F9L10M1
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcacctgccaggaaacaagagcccccacagagatcccgctcctagaggccctgccaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 325 - DNA, 1272 bp, Artificial Sequence
  The nucleotide sequence of F9L10M2
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 326 - DNA, 1260 bp, Artificial Sequence
  The nucleotide sequence of F9L10M3
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagctgctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggccccagccagggccggagccccagctacgccagc

SEQ ID NO: 327 - DNA, 1272 bp, Artificial Sequence
  The nucleotide sequence of F9L10M4
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 328 - DNA, 1272 bp, Artificial Sequence
  The nucleotide sequence of F9L10M5
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgaggaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 329 - DNA, 1272 bp, Artificial Sequence
  The nucleotide sequence of F9L10M6
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctgagcatggtggagcccagccagggccggagccccagctacgccagc

SEQ ID NO: 330 - DNA, 1272 bp, Artificial Sequence
  The nucleotide sequence of F9L10M7
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcaggagtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagctacgagagc

SEQ ID NO: 331 - DNA, 1272 bp, Artificial Sequence
  The nucleotide sequence of F9L10M8
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctgagcatggtgggcggcagccagggccggagccccagcgccgccagc

SEQ ID NO: 332 - DNA, 1272 bp, Artificial Sequence
  The nucleotide sequence of F9L10M9
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 333 - DNA, 1260 bp, Artificial Sequence
  The nucleotide sequence of F9L10M10
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcactgccccggcaacaagagcccccaccgggaccccgccccccggggcccctgccggttcctgcccctgcccggcctgccccccgccctgcccgagccccccggcatcctggccccccagccccccgacgtgggcagcagcgaccccctggccatggtgggcggcagccagggccggagccccagctacgccagc

SEQ ID NO: 334 - DNA, 1272 bp, Artificial Sequence
  The nucleotide sequence of F9L10M11
gagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccccatccccgacagcagccccctgctgcagttcggcggccaggtgcggcagcggtacctgtacaccgacgacgcccagcagaccgaggcccacctggagatccgggaggacggcaccgtgggcggcgccgccgaccagagccccgagagcctgctgcagctgaaggccctgaagcccggcgtgatccagatcctgggcgtgaagaccagccggttcctgtgccagcggcccgacggcgccctgtacggcagcctgcacttcgaccccgaggcctgcagcttccgggagcggctgctggaggacggctacaacgtgtaccagagcgaggcccacggcctgcccctgcacctgcccggcaacaagagcccccaccgggaccccgccccccggggccccgcccggttcctgcccctgcccggcctgccccccgccctgcccgagccccccggcatcctggccccccagccccccgacgtgggcagcagcgaccccctggccatggtgggcggcagccagggccggagccccagctacgagagc

SEQ ID NO: 335 - DNA, 1272 bp, Artificial Sequence; identical to SEQ ID NO: 332
  The nucleotide sequence of F9L10M12

SEQ ID NO: 336 - protein, 478 aa, Artificial Sequence
  The nucleotide sequence of C382L13F3L10M2
HSQGTFTSDYSKYLDSQAAQDFVQWLMNGGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 337 - DNA, 1434 bp, Artificial Sequence
  The nucleotide sequence of C382L13F3L10M2
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagcagacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgctagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 338 - protein, 479 aa, Artificial Sequence
  The nucleotide sequence of C382L13F9L10M2
HSQGTFTSDYSKYLDSQAAQDFVQWLMNGGPSSGAPPPSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 339 - DNA, 1437 bp, Artificial Sequence
  The nucleotide sequence of C382L13F9L10M2
cattcccaaggtacctttacttctgattactctaaatacttggattctcaagcggcccaggattttgtgcagtggctgatgaacggcggtccctcttctggtgctccaccaccttccggtggtggtggttctggaggaggaggcagtggcggtggcggatcagcagagagcaagtacggccccccttgcccaccctgtccagctcctgaggctgctggaggaccatccgtgttcctgtttcctccaaagcctaaggatacactgatgatcagccggacacctgaggtgacctgcgtggtggtggacgtgtctcaggaggatccagaggtgcagttcaactggtatgtggacggcgtggaggtgcacaatgctaagaccaagcctagagaggagcagtttaactccacataccgcgtggtgagcgtgctgaccgtgctgcatcaggattggctgaacggcaaggagtataagtgcaaggtgtccaataagggcctgccatccagcatcgagaagacaatcagcaaggctaagggacagcctagggagccacaggtgtacaccctgcccccttctcaggaggagatgacaaagaaccaggtgtccctgacctgtctggtgaagggcttctatccaagcgatatcgctgtggagtgggagtctaatggccagcccgagaacaattacaagaccacaccacccgtgctggactctgatggctccttctttctgtattctaggctgacagtggacaagtcccggtggcaggagggcaacgtgttttcttgctccgtgatgcatgaggctctgcacaatcattatacccagaagagcctctccctgtctttaggtggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

SEQ ID NO: 340 - protein, 478 aa, Artificial Sequence
  The nucleotide sequence of C495L13F3L10M2
HSQGTFTSDYSKYLDEQAAQDFVQWLMNGGPSSGAPPPSGGGGSGGGGSGGGGSADKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAGGGGAGGGGAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHCPGNKSPHRDPAPRGPCRFLPLPGLPPALPEPPGILAPQPPDVGSSDPLSMVGGSQGRSPSYES

SEQ ID NO: 341 - DNA, 1434 bp, Artificial Sequence
  The nucleotide sequence of C495L13F3L10M2
cacagccagggcaccttcaccagcgactacagcaagtacctggacgagcaggccgcccaggacttcgtgcagtggctgatgaacggcggccccagcagcggcgcccccccccccagcggtggtggtggttctggaggaggaggcagtggcggtggcggatcagcagacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgctagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggagctggcggcggcggcgcgggtggtggtggcgcccaccctatccccgacagcagccccctgctccagtttggcggccaggtgaggcagcggtatctgtacaccgatgatgcccagcagaccgaggctcacctggagatccgggaggacggcaccgtgggcggagctgctgatcagagccctgagtccctgctccagctgaaggctctgaagcctggcgtgattcagatcctgggcgtgaagacctccaggtttctgtgtcagaggcccgatggcgctctgtacggcagcctgcacttcgatcccgaggcttgcagcttcagggagcggctgctggaggacggctataacgtgtatcagagcgaggctcacggcctgcccctgcactgtccaggaaacaagagcccccacagagatcccgctcctagaggcccttgtaggtttctgcccctgcctggcctgccccctgccctgcctgaacctcctggcatcctggcccctcagcccccagacgtgggatcttccgaccctctgagcatggtgggcggctcccagggcagatccccctcttatgagagc

The invention claimed is:

1. A multi-domain active protein comprising a structure shown in Formula I: A-$L_a$-F-$L_b$-B, wherein A is a GCGR/GLP-1R dual-agonist active peptide, F is a long-acting protein unit, B is a native FGF21 or FGF21 analogue, $L_a$ does not exist or is a peptide linker, $L_b$ does not exist or is a peptide linker;
wherein an amino acid sequence of the A is selected from SEQ ID NO: 57 and SEQ ID NO: 66.

2. The multi-domain active protein according to claim 1, further comprising any one or more of the following: (1) the F is an $F_c$ portion derived from mammalian immunoglobulin; (2) when $L_a$ is a peptide linker, the $L_a$ is a peptide linker rich in G, S and/or A; (3) when $L_b$ is a peptide linker, the $L_b$ is a peptide linker rich in G, S and/or A.

3. An isolated polynucleotide, the isolated polynucleotide encodes the multi-domain active protein according to claim 1.

4. A recombinant expression vector comprising the isolated polynucleotide of claim 3.

5. A host cell, the host cell comprises the recombinant expression vector according to claim 4.

6. A method for preparing a multi-domain active protein comprising:
culturing the host cell according to claim 5 under suitable conditions to express the multi-domain active protein, isolating and purifying to obtain the multi-domain active protein, wherein
the multi-domain active protein comprises a structure shown in Formula I: A-$L_a$-F-$L_b$-B, wherein A is a GCGR/GLP-1R dual-agonist active peptide, F is a long-acting protein unit, B is a native FGF21 or FGF21 analogue, $L_a$ does not exist or is a peptide linker, and $L_b$ does not exist or is a peptide linker; and
wherein an amino acid sequence of the A is selected from SEQ ID NO: 57 and SEQ ID NO: 66.

7. A composition, comprising a culture of the host cell according to claim 5 and a pharmaceutically acceptable carrier.

8. A host cell, the host cell incorporates an exogenous isolated polynucleotide according to claim 3 in a genome.

9. A method for promoting weight loss comprising: administrating the multi-domain active protein according to claim 1 to a subject in need thereof.

10. The multi-domain active protein according to claim 1, wherein the multi-domain active protein is selected from SEQ ID NO: 160, SEQ ID NO: 167 and SEQ ID NO: 180.

11. A composition, comprising a multi-domain active protein and a pharmaceutically acceptable carrier, wherein the multi-domain active protein comprises a structure shown in Formula I: A-$L_a$-F-$L_b$-B, A is a GCGR/GLP-1R dual-agonist active peptide, F is a long-acting protein unit, B is a native FGF21 or FGF21 analogue, $L_a$ does not exist or is a peptide linker, $L_b$ does not exist or is a peptide linker; and wherein an amino acid sequence of the A is selected from SEQ ID NO: 57 and SEQ ID NO: 66.

12. A method for promoting weight loss comprising: administrating the composition according to claim 11 to a subject in need thereof.

13. A composition for treating metabolic and related diseases comprising a GCGR/GLP-1R dual-agonist active protein and a long-acting FGF21 analogue, wherein a structure of the GCGR/GLP-1R dual-agonist active protein comprises A-$L_a$-F, and a structure of the long-acting FGF21 analogue comprises F-$L_b$-B; and wherein an amino acid sequence of the A is selected from SEQ ID NO: 57 and SEQ ID NO: 66.

14. A method for promoting weight loss comprising: administrating the composition for treating metabolic and related diseases according to claim 13 to a subject in need thereof.

* * * * *